US008039608B1

(12) United States Patent
Bentwich

(10) Patent No.: US 8,039,608 B1
(45) Date of Patent: Oct. 18, 2011

(54) BIOINFORMATICALLY DETECTABLE GROUP OF NOVEL REGULATORY GENES AND USES THEREOF

(75) Inventor: Itzhak Bentwich, Kfar Daniel (IL)

(73) Assignee: Rosetta Genomics Ltd., Rehovot (IL)

( * ) Notice: Subject to any disclaimer, the term of this patent is extended or adjusted under 35 U.S.C. 154(b) by 2049 days.

(21) Appl. No.: 10/604,726

(22) Filed: Aug. 13, 2003

Related U.S. Application Data

(63) Continuation of application No. 10/293,338, filed on Nov. 14, 2002, now abandoned.

(51) Int. Cl.
*C12Q 1/68* (2006.01)
*C12P 19/34* (2006.01)
*C12N 15/00* (2006.01)
*C07H 21/02* (2006.01)
*C07H 21/04* (2006.01)

(52) U.S. Cl. ....... 536/24.5; 435/6; 435/91.1; 435/320.1; 536/23.1; 536/24.1

(58) Field of Classification Search ............. 435/6, 91.1, 435/91.31, 455, 458, 320.1; 536/23.1, 24.5, 536/24.1
See application file for complete search history.

(56) References Cited

U.S. PATENT DOCUMENTS

2002/0086356 A1 7/2002 Tuschl

FOREIGN PATENT DOCUMENTS

| WO | WO 01/68836 | | 9/2001 |
| WO | WO200190337 | * | 11/2001 |
| WO | WO200216649 | * | 2/2002 |
| WO | WO 02/44321 | | 6/2002 |

OTHER PUBLICATIONS

Lee, R. C., R. L. Feinbaum and V. Ambros. The *C. elegans* heterochronic gene lin-4 encodes small RNA s with antisense complementarity to lin-14 Cell Dec. 3, 1983 843-854 75.
Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.
Dsouza, M., N. Larsen and R. Overbeek. Searching for patterns in genomic data Trends Genet Dec. 1997 497-498 13.
Moss, E. G., R. C. Lee and V. Ambros. The cold shock domain protein LIN-28 controls developmental timing in *C. elegans* and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.
Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.
Verma, S. and F. Eckstein. Modified oligonucleotides: synthesis and strategy for users Annu Rev Biochem *No date in Pubmed* 1998 99-134 67.
Wuchty, S., W. Fontana, I. L. Hofacker and P. Schuster. Complete suboptimal folding of RNA and the stability of secondary structures Biopolymers Feb. 1999 145-165 49.
Mathews, D. H., J. Sabina, M. Zuker and D. H. Turner. Expanded sequence dependence of thermodynamic parameters improves prediction of RNA secondary structure J Mol Biol May 21, 1999 911-940 288.
Chang, P. L. Encapsulation for somatic gene therapy Ann N Y Acad Sci Jun 18, 1999 146-158 875.
Zhang, M. Q. Large-scale gene expression data analysis: a new challenge to computational biologists Genome Res Aug. 1999 681-688 9.
Grisaru, D., M. Sternfeld, A. Eldor, D. Glick and H. Soreq. Structural roles of acetylcholinesterase variants in biology and pathology Eur J Biochem Sep 1999 672-686 264.
Fire, A. RNA-triggered gene silencing Trends Genet Sep. 1999 358-363 15.
Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.
Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.
Olsen, P. H. and V. Ambros. The lin-4 regulatory RNA controls developmental timing in *Caenorhabditis elegans* by blocking LiN-14 protein synthesis after the initiation of translation Dev Biol Dec. 15, 1999 671-680 216.
Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

(Continued)

*Primary Examiner* — Jane Zara
(74) *Attorney, Agent, or Firm* — Polsinelli Shalton Flanigan Suelthaus PC; Teddy C. Scott, Jr.

(57) ABSTRACT

The present invention relates to a group of novel human genes, here identified as "genomic address messengers" or "GAM". GAM genes selectively inhibit translation of known "target" genes, many of which are known to be involved in various diseases. Several nucleic acid molecules are provided respectively encoding several GAM genes, as are vectors and probes both comprising the nucleic acid molecules, and methods and systems for selectively enhancing translation of the respective target genes, and for detecting expression thereof.

16 Claims, 28 Drawing Sheets

OTHER PUBLICATIONS

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. P granules in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M., Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E, and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopis SGS2 and SGS3 genes are required for posttranscriptional gene silencing and natural virus resistance Cell May 26 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995-1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny and introns in a large-scale *C. briggsae-C. elegans* genomic alignment Genome Res Aug. 2000 1115-1125 10.

Kennerdell, J. R. and R. W. Carthew. Heritable gene silencing in Drosophila using double-stranded RNA Nat Biotechnol Aug 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Mette MF, Aufsatz W. van der Winden J, Matzke MA, Matzke AJ. Transcriptional silencing and promoter methylation triggered by double-stranded RNA, EMBO J. Oct. 2, 2000 5194-201 19.

Yang, D., H. Lu and J. W. Erickson. Evidence that processed small dsRNAs may mediate sequence-specific mRNA degradation during RNAi in Drosophila embryos Curr Biol Oct. 5, 2000 1191-1200 10.

Anandalakshmi, R., R. Marathe, X. Ge, J. M. Herr, Jr., C. Mau, A Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGo1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded Suppressor of posttranscriptional gene silencing targets a maintenance step in the silencing pathway Proc Natl Acad Sci U S A Nov. 21 2000 13401-13406 9.

Cogoni, C. and G. Macino. Post-transcriptional gene silencing across kingdoms Curr Opin Genet Dev. Dec. 2000 638-643 10.

Elbashir, S. M., W. Lendeckel and T. Tuschl. RNA interference is mediated by 21- and 22-nucleotide RNAs Genes Dev Jan 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of *C. elegans* adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A, Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Vance, V. and H. Vaucheret, RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello, Genes and mechanisms related to RNA interference regulate expression of the small temporal RNAs that control *C. elegans* developmental timing Cell Jul. 13, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse, Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook, A computational approach to identify genes for functional RNAs in genomic sequences Nucleic Acids Res Oct. 1, 2001 3928-3938 29.

Moss, E. G. RNA interference: it's small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology, Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Jl. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-Arie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I Peluso and M. Furia, RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K. L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. BLAT—the BLAST-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun 17, 2002 3070-3080 21.

Ayash-Rashkovsky, M., A. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cotton-seed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates Drosophila growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopsis FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related Protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Bio Oct. 2002 444-451 5.

Golden, T. A., S. E. Schauer, J. D. Lang, S. Pien A. R. Muschegian, U. Grossniklaus, D. W. Meinke and A. Ray. Short Integuments1/Suspensor1/Carpel Factory, a Dicer homolog, is a maternal effect gene required for embryo development in Arabidopsis Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nonstranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov 1 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interferring RNAs and micro-RNAs in tobacco Proc Natl Acad Sci U S A Nov. 12, 2002 15228-15233 99.

Jones, L. Revealing micro-RNAs in plants Trends Plant Sci Nov. 2002 473-475 7.

Schauer, S. E., S. E. Jacobsen, D. W. Meinke and A. Ray. Dicer-Like1: blind men and elephants in Arabidopsis development Trends Plant Sci Nov. 2002 487-491 7.

Cohen, O., C. Erb, D. Ginzberg, Y. Pollak, S. Seidman, S. Shoham, R, Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Sprecher et al., Identification of Genetic Defect in the Hairless Gene in Atrichia with Papular Lesions: Evidence for Phenotypic Heterogeneity Among Inherited Atrichias, Am. J. Hum. Genet. 64:1323-1329 (1999).

Brockington, et al., Mutations in the Fukutin-Related Protein Gene (FKRP) Cause a Form of Congenital Muscular Dystrophy with Secondary Laminin alpha 2 Deficiency and Abnormal Glycosylation of alpha-Dystroglycan, Am. J. Hum. Genet. 69:1198-1209 (2001).

* cited by examiner

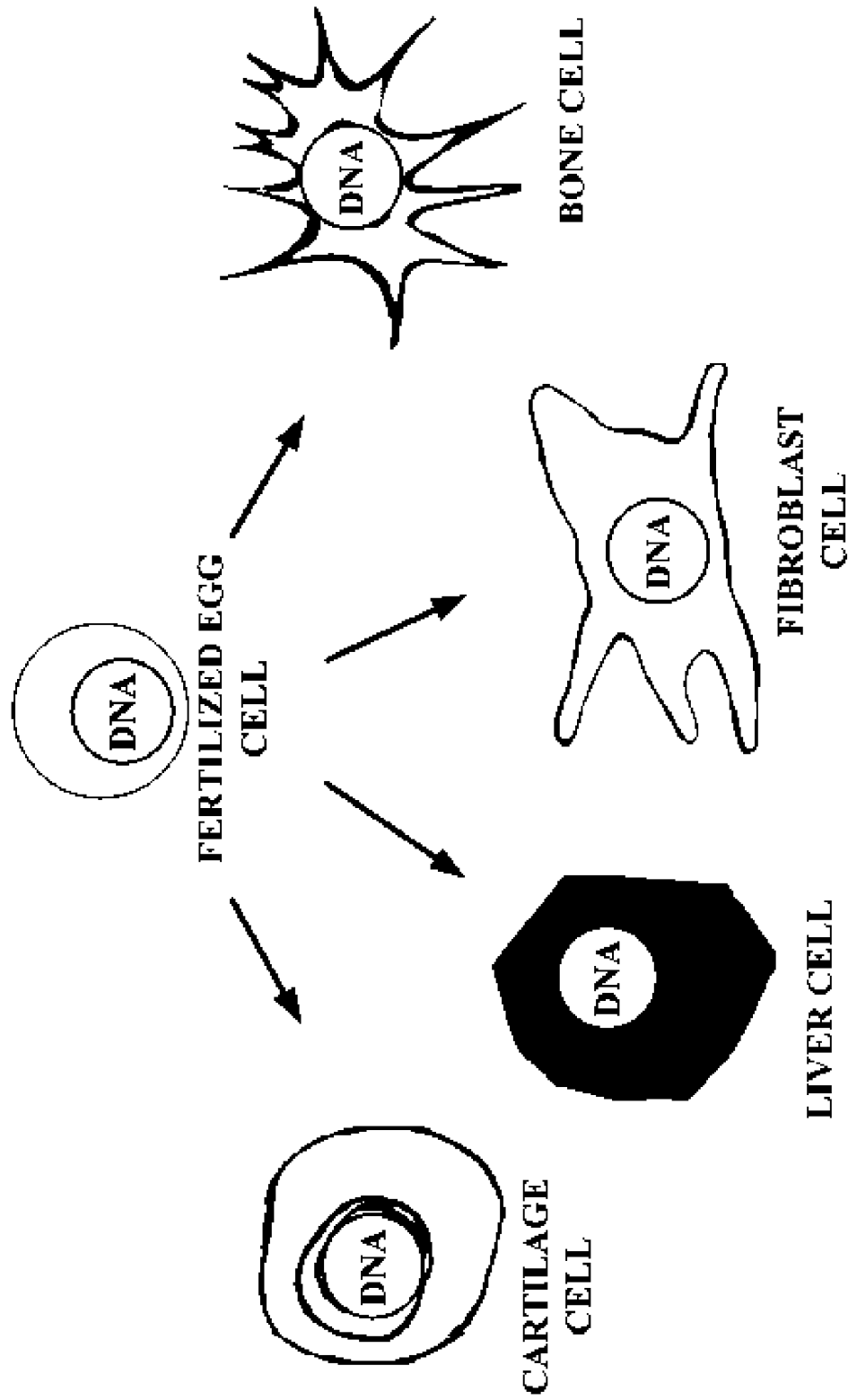

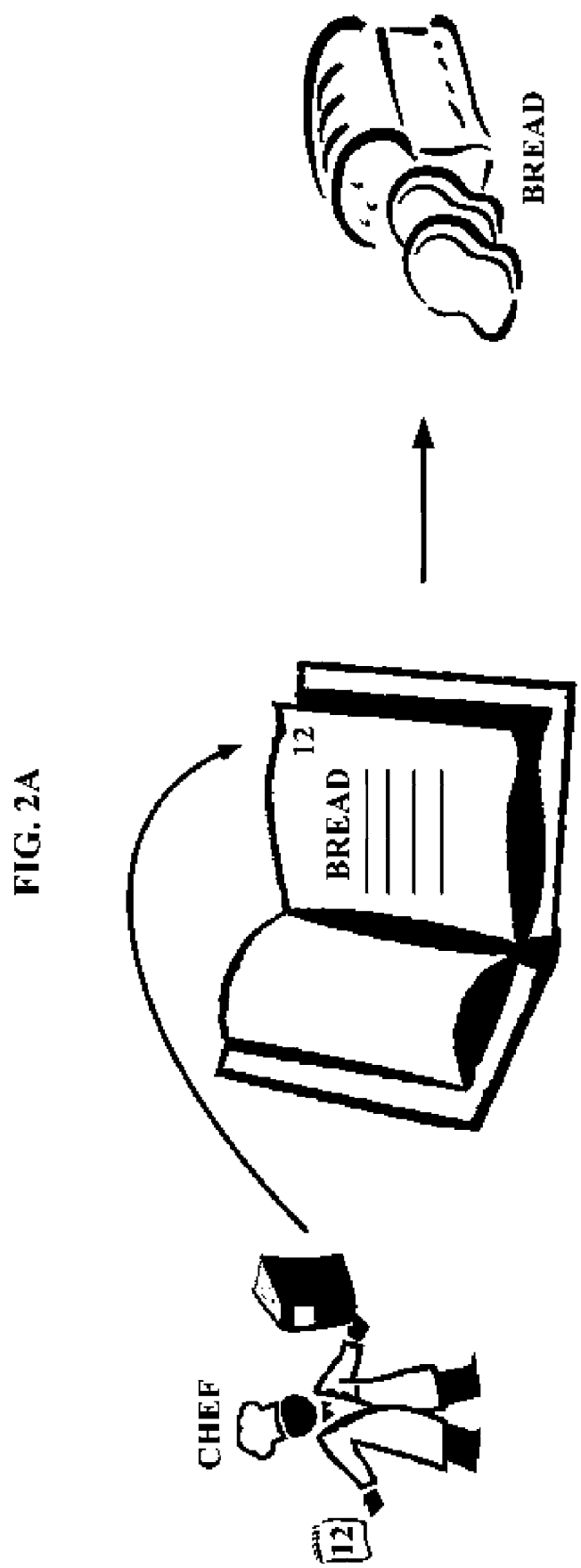

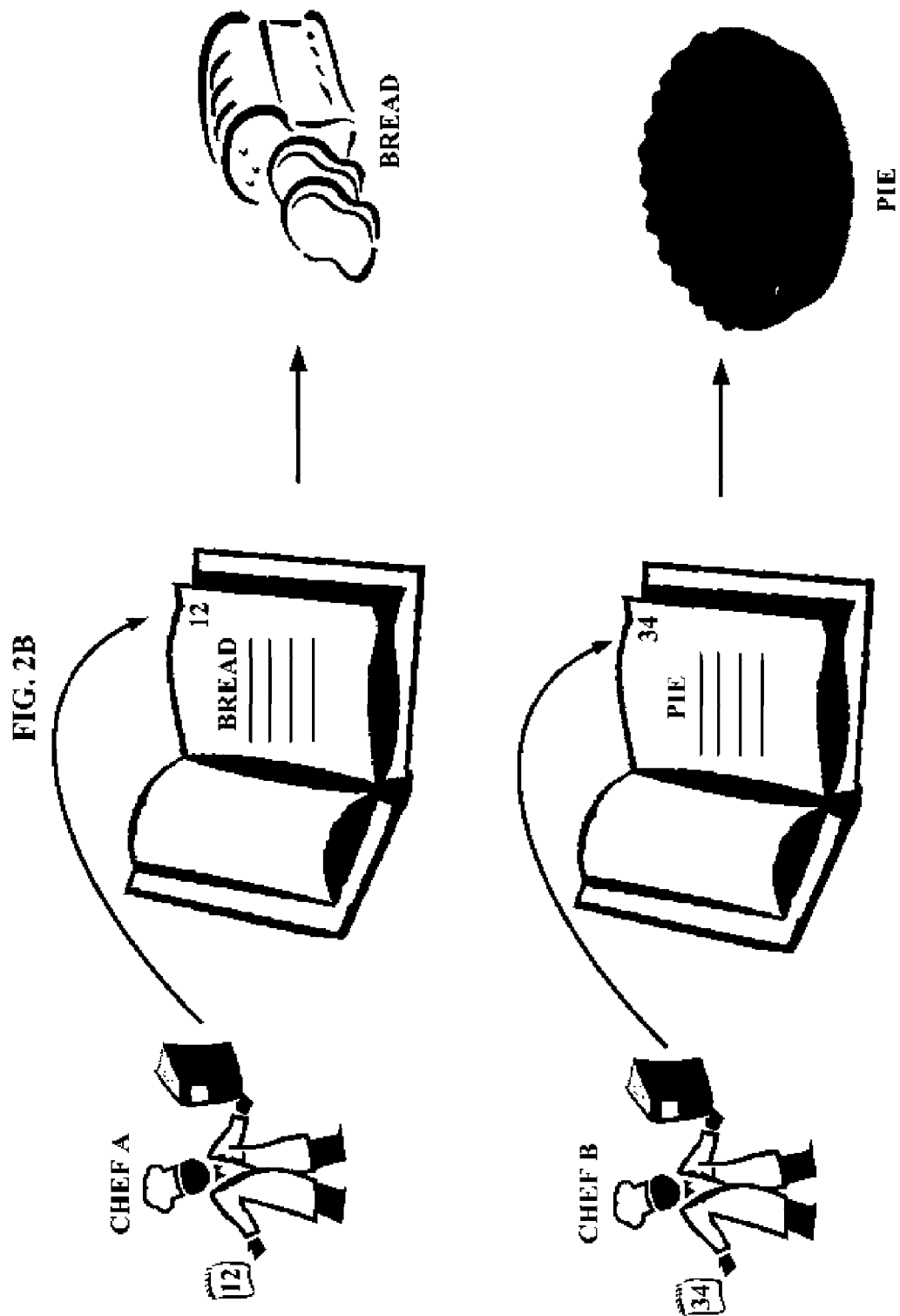

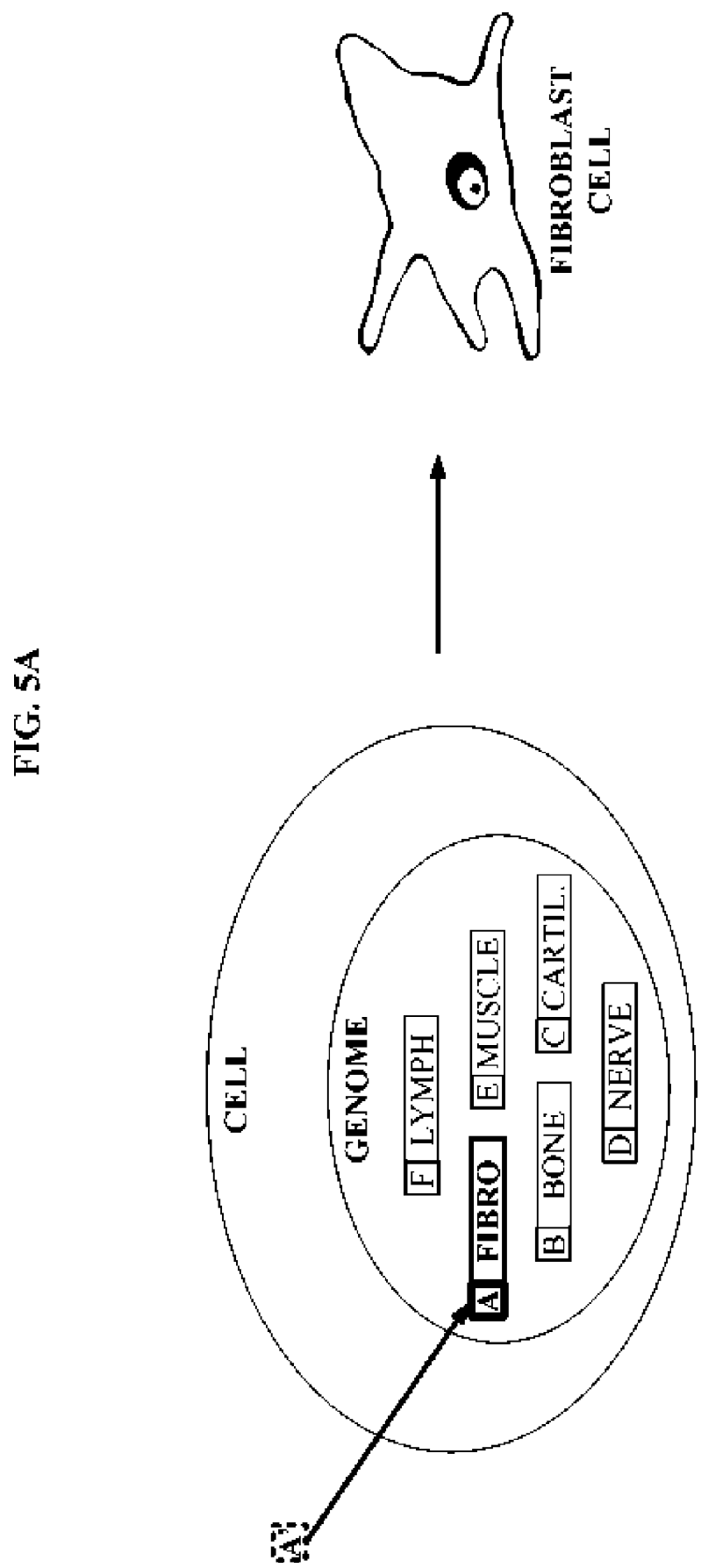

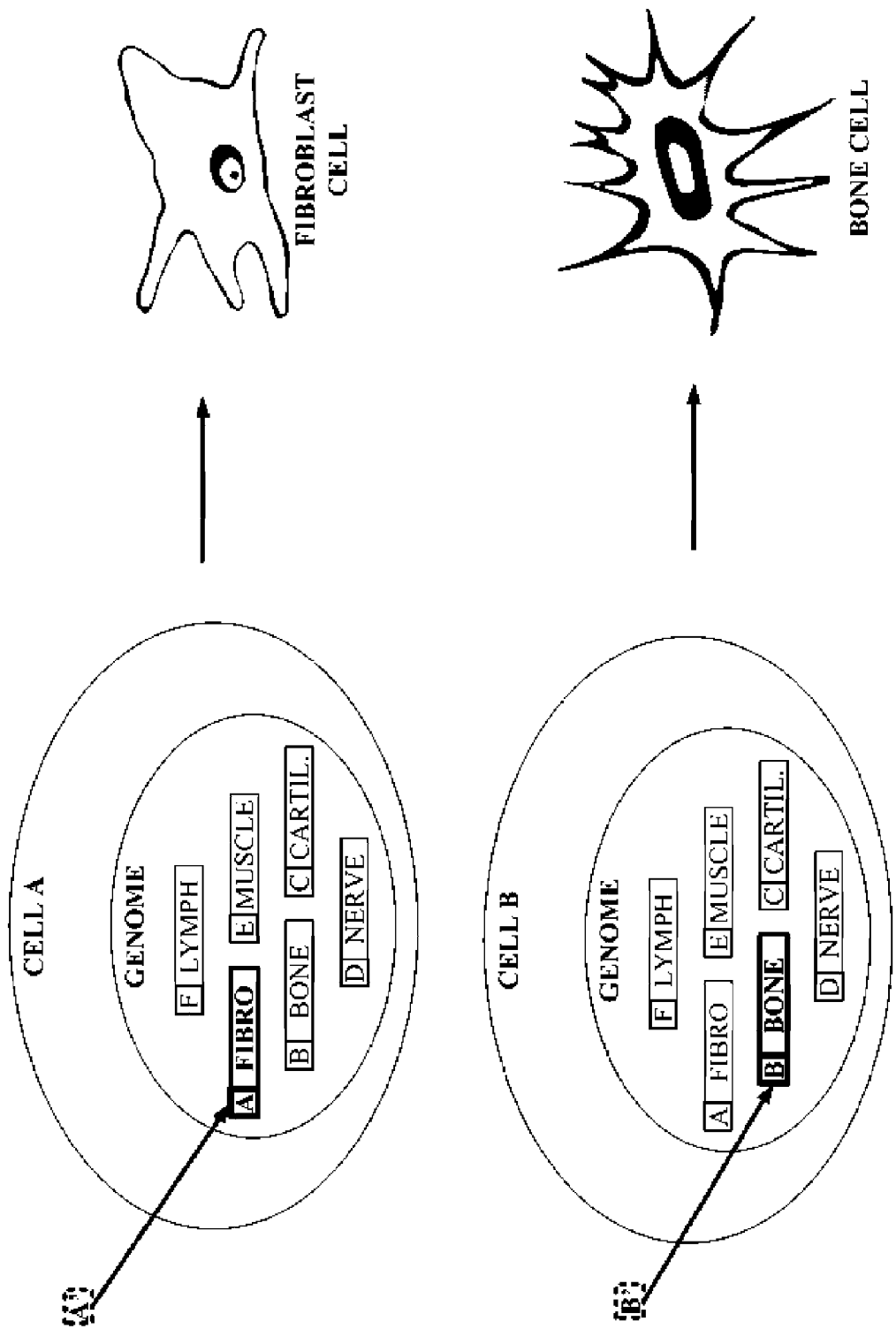

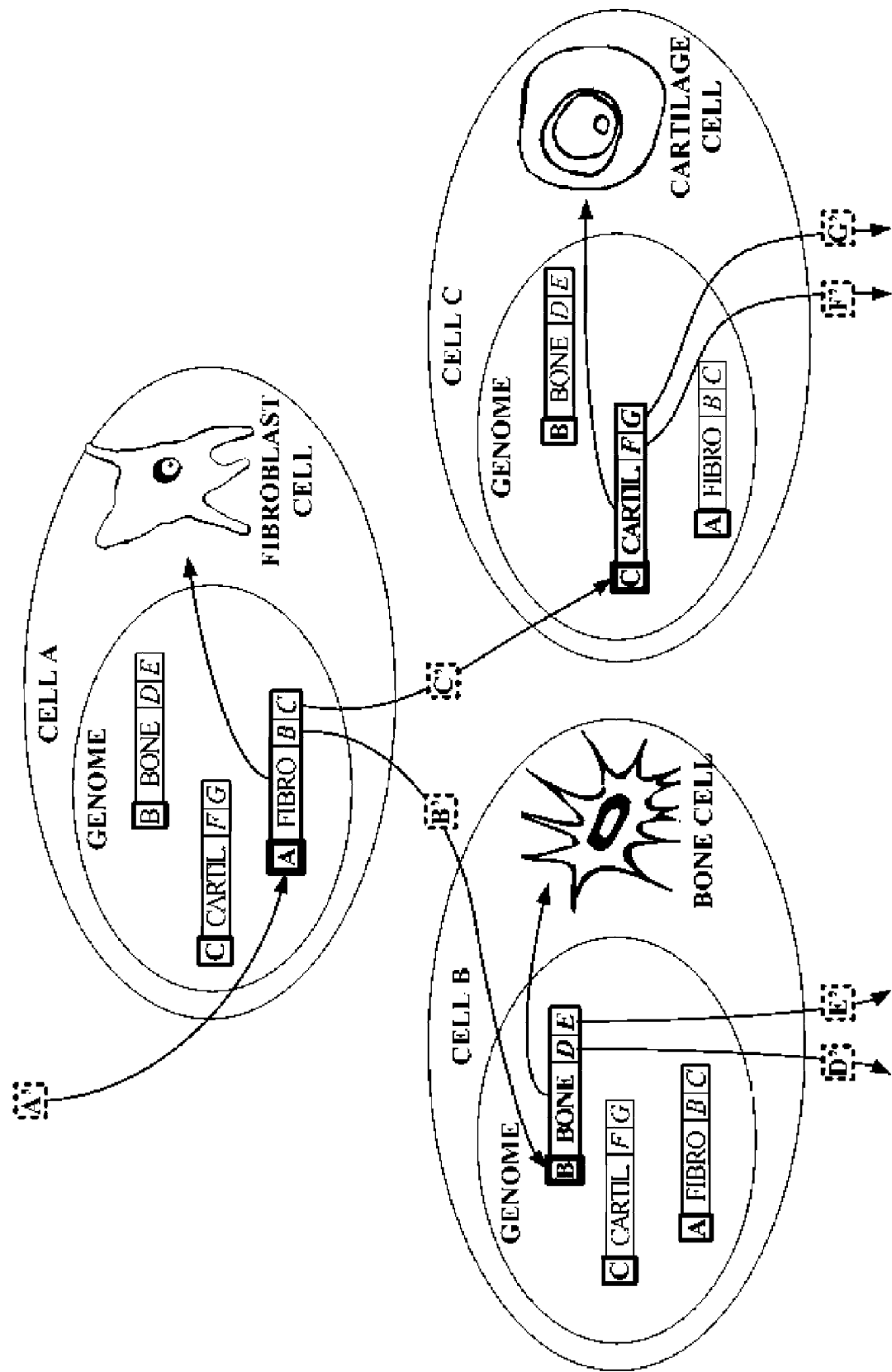

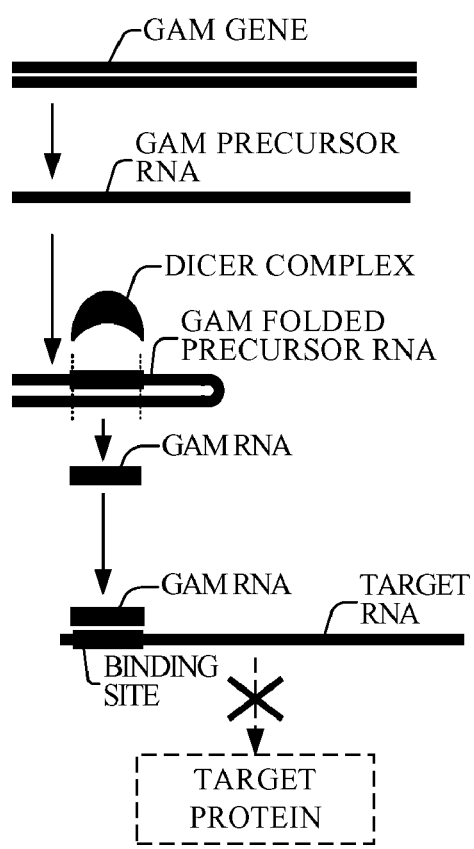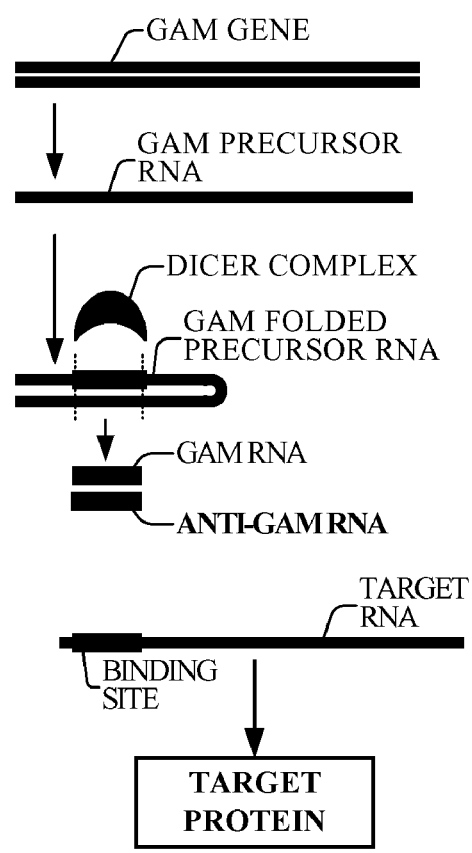

FIG. 21A

EST72223 sequence:
CCCTTATTAGAGGATTCTGCTCATGCCAGGGTGAGGTAGTAAGTTGTATTG
TTGTGGGGTAGGGATATTAGGCCCCAATTAGAAGATAACTATACAACT MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG GAM2
GCTTCAGTGAGCTGAGAACACGCCACTGCACTCCAGTCCTGGGCAAC        5
AGAGCAAGACTCTGTCTCAGGAAAAAAAAAG

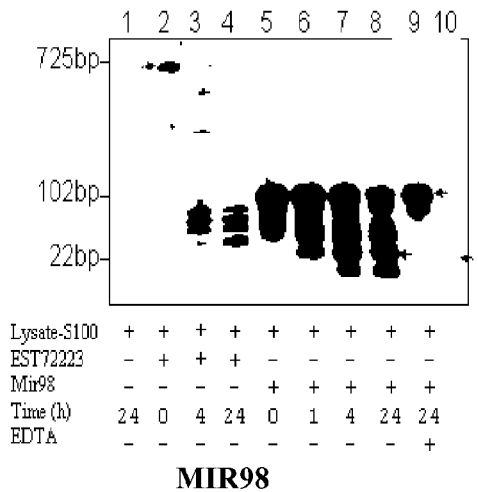

FIG. 21B

MIR98

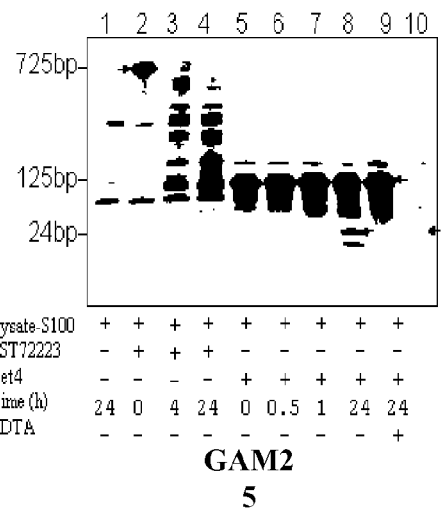

FIG. 21C

GAM2
5

FIG. 21D

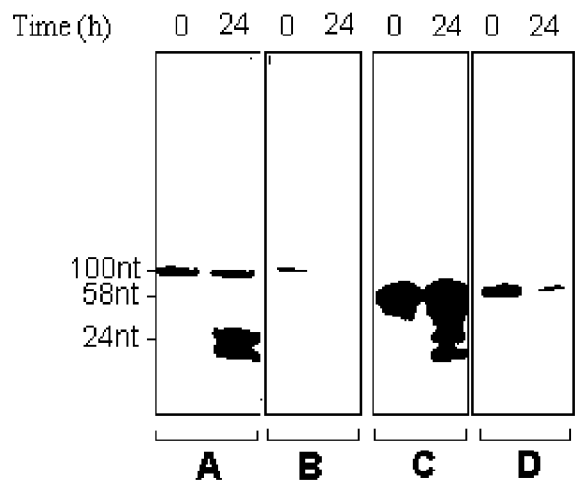

FIG. 22A

```
dbEST Id.7929020(Image4514344) sequence:
CCAAAAACTGCAAGCATTCCCTTTCAAAACTGCCACAAGACACGCATGCCCTCTCTCAC
CGCTCCTATTCAACATAGTGTTCGAAGTTCTGCCCAGGGCAATTAGGCAGGACAAGGAA
ATAAACGGTATTCAATTAGGAAAACAGCAACTCAAATTGTTCCTGTTTGCAGATGACAT
GATTGTATATCTAGAAAACCCCATTGTCTCAGCCCCAAATCTCCTTAAGCTGATAAGCA
ACTTCAGCAAAGTCTCAGGATACAAAATAAATCTACAAAAATCACAAGCATTCTTACAC
ACCAACAACAGAAAAACAGACCCAAATCATCACTCAACTCCCATTCACAATTCCTTCAA
AGAATAAAATACCTAGGAATCCAACTTACAAGGCATGTGAAGCACCTCTTCAAGGAG
AACTACAAACCACTGCTCAACGAAATAAAACAGGATACAAACAAATGGAAGAACATTCC
ATGCTCATGGTAGGAACAATCAATATTGTGAAAATGGCCATACTGCCCAAGCTAATTT
ACAGATTCAATGCCATCCCCATCAAGCTACCAATGACTTTCTTCACAGAATTGCAAAAA
ACTACTTTAAAGTTCATATGCAACCAAAAAAGAGCCCGCATGCCCAAGTCAATCCTAAG
CCAAAAGAACAAAGCTGGAGGCATCACACTACCTGACTTCAAACTTTACTACAAGGCTA  GAM24
CAGTAACCAAAACAGCCATGGTACTGGTACCAAAACAGAGATATACATCAATGCAACAGA
ACAGAGCCCTCAGAAATAACGCCCGAATACCAACTATCTGATCTTTGACAAACCTCA
GAAAAACAATGGGGAAAGCATTCCCTATTTAATAAATGCTGCTGGCAAAACTCAC
TAGCCATATGTACAAAGCTCAAACTGGATCCCTTCCTTACACCTTATACAAAAATCAAT
TCAAGATCCATTAAAGATTTAAACGTTACACCTAAAACCATAAAAACCCTAGAACAAAA
CCTAGCCATTACCATTCAGGACATAGGCATGGCCAAGGCACTTCATGTCCAAAACACCAA
AAGCAATGGCAACAAAACACAAAATTGACAAATGGGATCTAATTAAACTAAACACCTTC
TGCACAGCAAAACAAACTACCATCAGAGTGAACAGGCAACCTACAAAATGGGAGAAAAT
TTTCGCAACCTACTCATCTGACAAAGGGCTAATATCCAGAATCTACAATGAACTCAAAC  GAM26
AAATTTACAAAAAAAAAAAAAA
```

FIG. 22B

GAM26

FIG. 23A dbEST Id.1388749 (Image1020185) Sequence:
ACTCCTATCAACAGTGTAAAAGCATTCCTGTTTCTCCATAATCTTGCCAGCATCTTTT
CATTTTTTGAATTATAGCCATTCTGACTGTTGTGAGATGGTGTCTCATTGTGGTTTT
GATTTGCATTTCTCAGATGATCAGTGATGTTGAAGTTTTTTGTTTGTTGGCTGCATG
TATGCCTTCTTTTGAAAAGTGTCTGTTTGTGTCCTTTGACCACTTTCTAATGGGGTTG
AGTTTTTTTTCTTGTAAATTTGTTTAAGTTCCTTGTAGATGCTGGATATTAGACCTT
TGTCAGATGGATAGAGTGCAAAAATTTTCTCCCATTCTGTAGGTTGTCGGTTTACTCT
GTTGATAGGTTCTTAATGCTGTGCAGAAGCTCTTTAGTTTAATTAGATCCCATTTGTC
AATTTGGCTTTTGTTGCAATTGCTTTGGCATCTTCGTCATGAAATCTTTGCCCTTG
CCTGTGTCCTGAATGGCATTGCCTAGGTTTTCTTCCAGGATTTTTATAGTTTTGGGTT
GTAGATTTAAGTCTTTAATCCATCTTGAGTTAACTTTGTATATGGGTTAAGGAAGGG
GCCGTTTCAATTTGCTGCAAATGGCTAGCCAGTTCTCCCAGCACCATTTATTAAATA
GGGAATCTTTTCCCCATTGCTTCCTTTGTCAGGTTTGTCAAAGATCACATGGTTGTA
GGTGTGTGGTCTTATTTCTGGGTTCTCTATTCTGTTCCATTGGGCTATGGGCCGGTTC
TGTACCACCACTATGCTGTTTTGGGTACCATAGTCTTGTAGAATGTTTGAAGCTGGGT
AGCATGATGCCTCTAGCTTTGCTCTTCTTGCTAAGAAATGTCTTGGCTATTTGGGCTC
TTTTTTGGTTCCATATGAATTTTAAAATAGCTTTTTCTAGGTCTGTAAAGAATGTGAA
TAGTAGTTTAATGGGCCTAGCATTTAATTTACAGATTGCCTTGGGCAGTGTGGTCATT
TTCACGATATTGATCCTTCCTGTCTGTGAGCATATGTTT**TTCCATTTGTTTGTGTCAT
CTCTGATTTCTTTGAATAATGGTTTATAGTTATCCTTGAAAAGGTCCTTCACTTTTCT** GAM 27
TGTTAGCTGTATTCCTAGATATTATACTCTTCTTGTGGCAATTGTGAATGGGAGTTAA
TTCATGAGTTTTCTCTCGGCTTGCCTGTTGTTGGTGTATAGGAATGCTAGTGACTTTT
GCACATTGATTTTGTATCCTGAGACTTTGTTGAAGTTGCTTATCAGCTAAGAAGTTTT
TGAGCTGAGATGATGGAGTTTTCTAGATATAGGATCATATCATCTGCAAACAAAGATA
GTTTGACTTCCTGTCTTCCTATTTGAATAGCTTTTCTTTCTTTCTCTTGCCTGATTGC
CTTGGTGAGAATTTCTAATACTGTGTTGAATAGGAGTGGTGAGCTCGTGCCAA

FIG. 23B

GAM27

US 8,039,608 B1

BIOINFORMATICALLY DETECTABLE GROUP OF NOVEL REGULATORY GENES AND USES THEREOF

CROSS REFERENCE TO RELATED APPLICATIONS

The present invention is a continuation of application Ser. No. 10/293,338 filed Nov. 14, 2002 incorporated herein, now abandoned.

APPENDIX DATA

Computer Disk OBJECT_ID Sequence listing part
Computer Disk 2 OBJECT_ID #2 Sequence listing (copy 2)

BACKGROUND OF INVENTION

1. Field of the Invention

The present invention relates to a group of bioinformatically detectable novel genes, here identified as "genomic address messenger" or "GAM" genes, which are believed to be related to the micro RNA (miRNA) group of genes.

2. Description of Prior Art

Over 300 small noncoding RNA's, termed Micro RNA's (miRNA's), have been identified to date in animals and plants (1-8). The MIR genes, code for ~70-120 nt long non-protein-coding RNA sequences, that are the precursors of the ~22 nt miRNA sequences, which in some cases, specifically inhibit translation of target genes, by complementary binding to their untranslated regions (UTR) (9-13). The first two MIR genes discovered, Lin-4 and Let-7, were found in the nematode *Ceanorhabditis elegans*, and shown to be involved in developmental timing (14, 15), hence originally called Short Temporal RNA (stRNA) (16). The ~22 nt sequences inhibit translation of two respective target genes, Lin-14 and Lin-41, by complementary binding to their 3" untranslated regions (UTR) (14, 17). Later studies by three separate groups (1-3) identified several precursor and mature miRNA's, some of them in clusters (1), expressed as sequences found in size fractionated (<80 nt) total RNA, in a wide spectrum of species, including *C. elegans, Drosophila melanogaster, Homo sapiens*, as well as plants. More recently, additional miRNA's from human (mir-91 to mir-121 (6)), mouse (mir-122 to mir-155 (4)) and plants (mir-156 to mir-171 (5)), have been reported. Furthermore, Llave et al identified in *Arabidopsis thaliana* 125 sequences, 21-24 nucleotides in length and presumably miRNAs (8). Each of the MIR genes is transcribed and processed to an ~80 nt-long hairpin shaped miRNA precursor, which is then processed by an enzyme called Dicer, to yield the mature ~22 nt-long single stranded miRNA. Such small RNAs will inhibit translation of target genes by complementary binding to sites in the 3" or 5" untranslated regions (18). Their structural similarity to the two well-studied miRNA's in *C. elegans*, Lin-4 and Let-7, supports the belief that MIR genes code for specific translation inhibitors of target genes. However, determining the targets of the miRNAs is more complicated than just searching for antisense complementarity, because bulges and loops, disrupting perfect complementarity, are not only tolerated, but seem to be the rule in the postulated binding between the miRNA's and their target UTR's (19). Target-gene binding sites of most reported miRNA's, except of Lin-4 and Let-7, have not been found, and therefore the specific functionality of these genes is still unknown. Using a computational approach, Rhoades et al (19), predicted targets for 14 *A. thaliana* miRNA's by identifying their near complementarity to the predicted targets. However, using the same approach was not helpful in identifying miRNA targets in *C. elegans* and *D. melanogaster*, raising the possibility that the near-perfect complementarity appears to be specific to plants (19).

The ability to detect novel RNA genes is limited by the methodologies used to detect such genes. All RNA genes identified so far either present a visibly discernable whole body phenotype, as do Lin-4 and Let-7 (Wightman et. al., Cell 75, 855 (1993); Reinhart et al., Nature 403, 901 (2000)), or produce significant enough quantities of RNA so as to be detected by the standard biochemical genomic techniques, as do the 93 recently detected miRNA genes. Since a limited number clones were sequenced by the researchers discovering these genes, 300 by Bartel and 100 by Tuschl (Bartel et. al., Science 294, 858 (2001); Tuschl et. al., Science 294, 853 (2001)), the RNA genes found can not be much rarer than 1% of all RNA genes. The recently detected miRNA genes therefore represent the more prevalent among the miRNA gene family.

Current methodology has therefore been unable to detect RNA genes which either do not present a visually discernable whole body phenotype, or are rare (e.g. rarer than 0.1% of all RNA genes), and therefore do not produce significant enough quantities of RNA so as to be detected by standard biochemical technique.

SUMMARY OF INVENTION

The present invention relates to a novel group of regulatory, non-protein coding genes, which are functional in specifically inhibiting translation of other genes, some of which are known to be involved in various diseases. Each gene in this novel group of genes, here identified as "GAM" or "Genomic Address Messengers", specifically inhibits translation of one of more other "target" genes by means of complimentary hybridization of a segment of the RNA transcript encoded by GAM2, to an inhibitor site located in the 3" untranslated region of the mRNA of the one or more "target" genes.

In various preferred embodiments, the present invention seeks to provide improved method and system for specific modulation of expression of specific known "target" genes involved in significant human diseases, and improved method and system for detection of expression of these target genes.

Accordingly, the invention provides several substantially pure DNAs (e.g., genomic DNA, cDNA or synthetic DNA) each encoding a novel gene of the GAM group of gene, vectors comprising the DNAs, probes comprising the DNAs, a method and system for selectively modulating translation of known "target" genes utilizing the vectors, and a method and system for detecting expression of known "target" genes utilizing the probe.

By "substantially pure DNA" is meant DNA that is free of the genes which, in the naturally-occurring genome of the organism from which the DNA of the invention is derived, flank the genes discovered and isolated by the present invention. The term therefore includes, for example, a recombinant DNA which is incorporated into a vector, into an autonomously replicating plasmid or virus, or into the genomic DNA of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant DNA which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibiter site" is defined as the minimal DNA sequence sufficient to inhibit translation.

There is thus provided in accordance with a preferred embodiment of the present invention a bioinformatically detectable novel gene encoding substantially pure DNA wherein: RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel gene is a partial inversed-reversed sequence of a nucleotide sequence of a binding site associated with at least one target gene, the novel gene cannot be detected by either of the following: a visually discernable whole body phenotype, and detection of 99.9% of RNA species shorter than 25 nucleotides expressed in a tissue sample, and a function of the novel gene is bioinformatically deducible.

There is further provided in accordance with another preferred embodiment of the present invention a bioinformatically detectable novel gene encoding substantially pure DNA wherein: RNA encoded by the bioinformatically detectable novel gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel gene is a partial inversed-reversed sequence of nucleotide sequence of a second half thereof, a nucleotide sequence of each of the RNA segments encoded by the novel gene is a partial inversed-reversed sequence of the nucleotide sequence of a binding site associated with at least one target gene, and a function of the novel gene is bioinformatically deducible from the following data elements: the nucleotide sequence of the RNA encoded by the novel gene, a nucleotide sequence of the at least one target gene, and function of the at least one target gene.

There is still further provided in accordance with another preferred embodiment of the present invention a bioinformatically detectable novel gene encoding substantially pure DNA wherein: RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel gene is a partial inversed-reversed sequence of a nucleotide sequence of a binding site associated with at least one target gene, a function of the novel gene is modulation of expression of the at least one target gene, and the at least one target gene does not encode a protein.

There is additionally provided in accordance with another preferred embodiment of the present invention A bioinformatically detectable novel gene encoding substantially pure DNA wherein: the bioinformatically detectable novel gene does not encode a protein, RNA encoded by the bioinformatically detectable novel gene is maternally transferred by a cell to at least one daughter cell of the cell, a function of the novel gene includes modulation of a cell type of the daughter cell, and the modulation is bioinformatically deducible.

There is moreover provided in accordance with another preferred embodiment of the present invention a bioinformatically detectable novel gene encoding substantially pure DNA wherein: the bioinformatically detectable novel gene does not encode a protein, a function of the novel gene is promotion of expression of the at lease one target gene, and the at least one target gene is bioinformatically deducible.

Further in accordance with a preferred embodiment of the present invention the function of the novel gene is bioinformatically deducible from the following data elements: the nucleotide sequence of the RNA encoded by the bioinformatically detectable novel gene, a nucleotide sequence of the at least one target gene, and a function of the at least one target gene.

Still further in accordance with a preferred embodiment of the present invention the RNA encoded by the novel gene complementarily binds the binding site associated with the at least one target gene, thereby modulating expression of the at least one target gene.

Additionally in accordance with a preferred embodiment of the present invention the binding site associated with at least one target gene is located in an untranslated region of RNA encoded by the at least one target gene.

Moreover in accordance with a preferred embodiment of the present invention the function of the novel gene is selective inhibition of translation of the at least one target gene, which selective inhibition includes complementary hybridization of the RNA encoded by the novel gene to the binding site.

Further in accordance with a preferred embodiment of the present invention the invention includes a vector including the DNA.

Still further in accordance with a preferred embodiment of the present invention the invention includes a method of selectively inhibiting translation of at least one gene, including introducing the vector.

Moreover in accordance with a preferred embodiment of the present invention the introducing includes utilizing RNAi pathway.

Additionally in accordance with a preferred embodiment of the present invention the invention includes a gene expression inhibition system including: the vector, and a vector inserter, functional to insert the vector into a cell, thereby selectively inhibiting translation of at least one gene.

Further in accordance with a preferred embodiment of the present invention the invention includes a probe including the DNA.

Still further in accordance with a preferred embodiment of the present invention the invention includes a method of selectively detecting expression of at least one gene, including using the probe.

Additionally in accordance with a preferred embodiment of the present invention the invention includes a gene expression detection system including: the probe, and a gene expression detector functional to selectively detect expression of at least one gene.

BRIEF DESCRIPTION OF DRAWINGS

FIG. 1 is a simplified diagram illustrating the genomic differentiation enigma that the present invention addresses;

FIGS. 2 through 4 are schematic diagrams which when taken together provide an analogy that illustrates a conceptual model of the present invention, addressing the genomic differentiation enigma;

FIGS. 5A and 5B are schematic diagrams, which when taken together illustrate a "genomic records" concept of the conceptual model of the present invention, addressing the genomic differentiation enigma;

FIG. 6 is a schematic diagram illustrating a "genomically programmed cell differentiation" concept of the conceptual model of the present invention, addressing the genomic differentiation enigma;

FIGS. 20A and 20B are simplified diagrams, which when taken together illustrate a mode of gene therapy applicable to genes of the novel group of genes of the present invention;

FIG. 21A is an annotated sequence of EST72223 (SEQ ID NO: 8788) comprising novel gene GAM24 detected by the gene detection system of the present invention;

FIGS. 21B and 21C are pictures of laboratory results, which when taken together demonstrate laboratory confirmation of expression of the bioinformatically detected novel gene GAM24 of FIG. 21A;

FIG. 21D provides pictures of laboratory results, which when taken together demonstrate further laboratory confirmation of expression of the bioinformatically detected novel gene GAM24 of FIG. 21A;

FIG. 22A is an annotated sequence of an EST7929020 (SEQ ID NO: 8789) comprising novel genes GAM23 and GAM25 detected by the gene detection system of the present invention;

FIG. 22B is a picture of laboratory results, which confirm expression of bioinformatically detected novel genes GAM23 and GAM25 of FIG. 22A;

FIG. 23A is an annotated sequence of an EST1388749 (SEQ ID NO: 8790) comprising novel gene GAM26 detected by the gene detection system of the present invention;

FIG. 23B is a picture of laboratory results, which confirm expression of the bioinformatically detected novel gene GAM26 of FIG. 23A;

BRIEF DESCRIPTION OF SEQUENCES

A Sequence Listing of genomic sequences of the present invention is attached to this application, enclosed in computer readable form.

Detailed Description

Reference is now made to FIG. 1 which is a simplified diagram providing a conceptual explanation of a genomic differentiation enigma, which the present invention addresses.

Referring to FIG. 1, it is appreciated that different cell types in an organism, such as CARTILAGE CELL, LIVER CELL, FIBROBLAST CELL and BONE CELL all contain identical DNA, and derive from the initial FERTILIZED EGG CELL, and yet each of these cells expresses different proteins, and hence acquires different shape and function.

The present invention proposes that the inevitable conclusion from this constraint is, however, strikingly simple: the coding system used must be modular. It must comprise multiple modules, or records, one for each cell-type, and a mechanism whereby each cell at its inception is instructed which record to open, and behaves according to instructions in that record.

This modular code concept is somewhat difficult to grasp, since we are strongly habituated to viewing things from an external viewpoint. An architect, for example, looks at a blueprint of a building, which details exactly where each element (block, window, door, electrical switch, etc.) is to be placed relative to all other elements, and then instructs builders to place these elements in their designated places. This is an external viewpoint: the architect is external to the blueprint, which itself is external to the physical building, and its different elements. The architect may therefore act as an "external organizing agent": seeing the full picture and the relationships between all elements, and being able to instruct from the outside where to place each of them.

Genomics differentiation coding evidently works differently, without any such external organizing agent: It comprises only one smart block (the first cell), which is the architect and the blueprint, and which continuously duplicates itself, somehow knowing when to manifest itself as a block and when as a window, door, or electrical switch.

Figure 3:
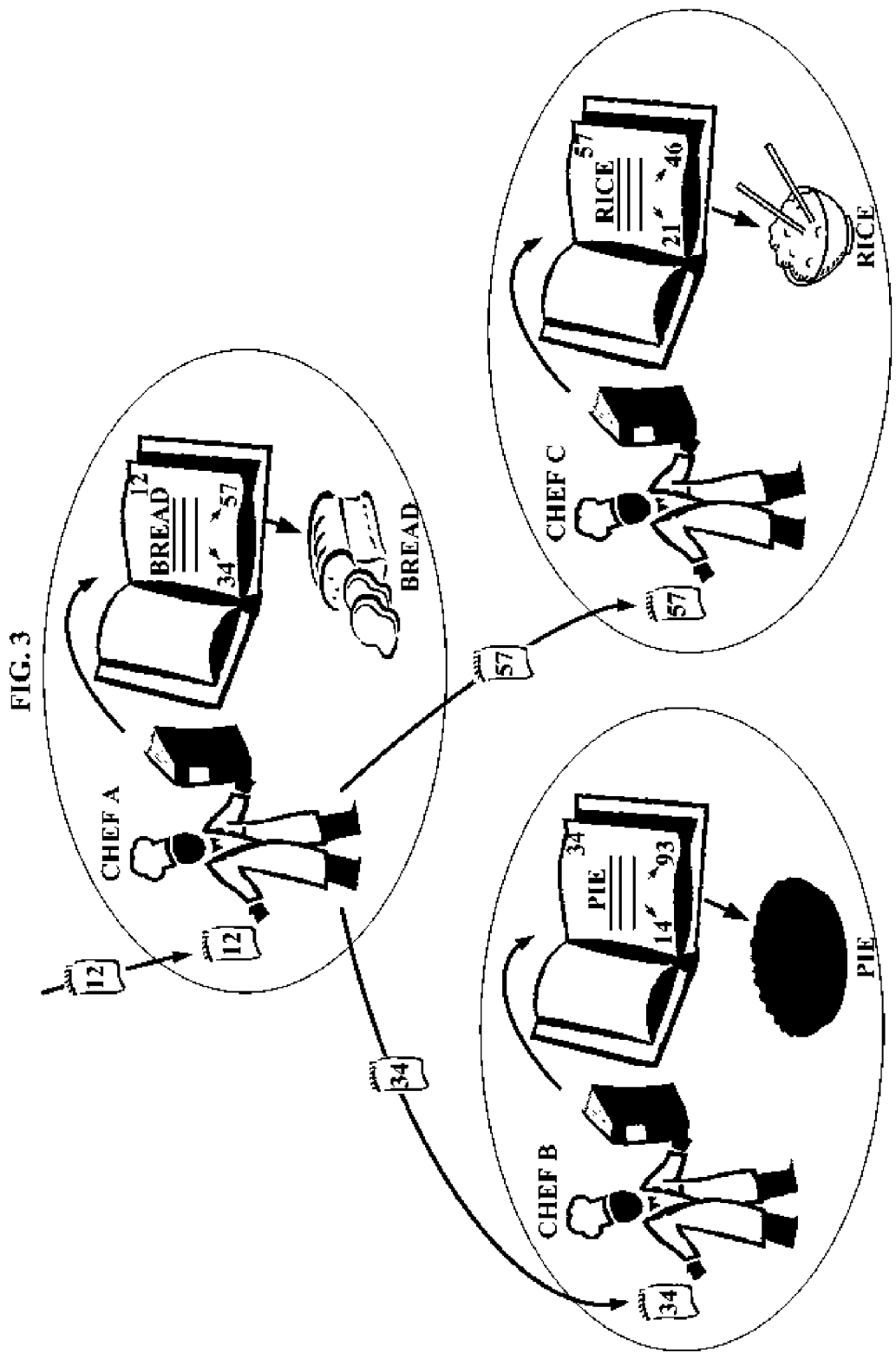
Figure 4:
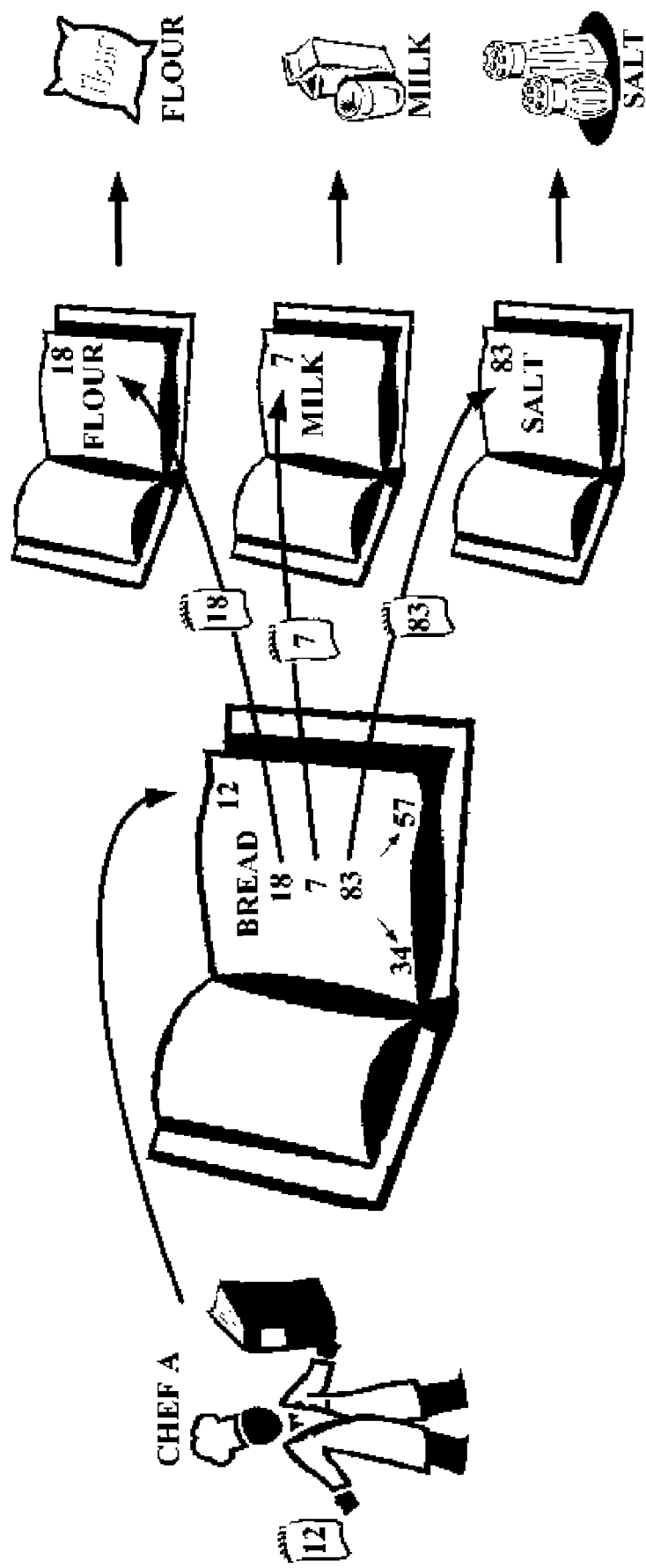

Reference is now made to FIGS. 2 through 4 which are schematic diagrams which when taken together provide an analogy that illustrates a conceptual model of the present invention, addressing the genomic differentiation enigma.

Referring to FIG. 2A, imagine a very talented chef, capable of preparing any meal provided he is given specific written cooking instructions. This chef is equipped with two items: (a) a thick recipe book, and (b) a small note with a number scribbled on it. The book comprises multiple pages, each page detailing how to prepare a specific meal. The small note indicates the page to be opened, and therefore the meal to be prepared. The chef looks at the page-number written on the note, opens the recipe book at the appropriate page, and prepares the meal according to the written instructions on this page. As an example, FIG. 2A depicts a CHEF holding a note with the number 12 written on it, he opens the book on page 12, and since that page contains the recipe for preparing BREAD, the CHEF prepares a loaf of BREAD.

Referring now to FIG. 2B, which depicts two identical chefs, CHEF A and CHEF B, holding an identical recipe book. Despite their identity, and the identity of their recipe book, since CHEF A holds a note numbered 12, and therefore opens the book on page 12 and prepares BREAD, whereas CHEF B holds a note numbered 34 and therefore opens the book on page 34 and prepares a PIE.

Referring now to FIG. 3. Imagine the chef of the analogy is also capable of duplicating himself once he has finished preparing the specified meal. The format of the book is such that at the bottom of each page, two numbers are written. When he has finished preparing the meal specified on that page, the chef is trained to do the following: (i) divide himself into two identical duplicate chefs, (ii) duplicate the recipe book and hand a copy to each of his duplicate chefs, and (iii) write down the two numbers found at the bottom of the page of the meal he prepared, on two small notes, handing one note to each of his two duplicate chefs.

Each of the two resulting duplicate chefs are now equipped with the same book, and have the same talent to prepare any meal, but since each of them received a different note, they will now prepare different meals.

FIG. 3 depicts CHEF A holding a recipe book and receiving a note numbered 12. CHEF A therefore opens the book on page 12 and prepares BREAD. When he is finished making bread, CHEF A performs the following actions: (i) divides himself into two duplicate chefs, designated CHEF B and CHEF C, (ii) duplicates his recipe book handing a copy to each of CHEF B and CHEF C, (iii) writes down the numbers found at the bottom of page 12, numbers 34 and 57, on two notes, handing note numbered 34 to CHEF B and note numbered 57 to CHEF C.

Accordingly, CHEF B receives a note numbered 34 and therefore opens the recipe book on page 34 and prepares PIE, whereas CHEF C receives a note numbered 57 and therefore opens the book on page 57 and therefore prepares RICE.

It is appreciated that while CHEF A, CHEF B & CHEF C are identical and hold identical recipe books, they each prepare a different meal. It is also appreciated that the meals prepared by CHEF B and CHEF C are determined CHEF A, and are mediated by the differently numbered notes passed on from CHEF A to CHEF B and CHEF C.

It is further appreciated that the mechanism illustrated by FIG. 3 enables an unlimited lineage of chefs to divide into duplicate, identical chefs and to determine the meals those duplicate chefs would prepare. For example, having been directed to page 34, when CHEF B divides into duplicate chefs (not shown), he will instruct its two duplicate chefs to prepare meals specified on pages 14 and 93 respectively, according to the numbers at the bottom of page 34 to which he was directed. Similarly, CHEF C will instruct its duplicate chefs to prepare meals specified on pages 21 and 46 respectively, etc.

Referring now to FIG. 4. Imagine that the cooking instructions on each page of the recipe book are written in shorthand format: The main meal-page to which the chef was directed by the scribbled note, merely contains a list of numbers which direct him to multiple successive pages, each specifying how to prepare an ingredient of that meal.

As an example, FIG. 4 depicts CHEF A of FIGS. 2 and 3, holding a recipe book and a note numbered 12. Accordingly, CHEF A opens the recipe book on page 12, which details the instructions for preparing BREAD. However, the "instructions" on making BREAD found on page 12 comprise only of 3 numbers, 18, 7 and 83, which "refer" CHEF A to pages detailing preparation of the ingredients of BREAD FLOUR, MILK and SALT, respectively.

As illustrated in FIG. 4, turning from the main "meal page" (e.g. 12) to respective "ingredients pages" (e.g. pages 18, 7 & 83) is mediated by scribbled notes with the page-numbers written on them. In this analogy, the scribbled notes are required for seeking the target pages to be turned to both when turning to main "meal pages" (e.g. page 12), as well as when turning to "ingredient pages" (e.g. pages 18, 7 & 83).

The chef in the given analogy, schematically depicted in FIGS. 2 through 4, represents a cell; the thick recipe book represents the DNA; preparing a meal in the given analogy represents the cell manifesting itself as a specific cell-type; and ingredients of a meal represent proteins expressed by that cell-type. Like the chef equipped with the thick recipe book in the given analogy, all cells in an organism contain the same DNA and are therefore each potentially capable of manifesting itself as any cell-type, expressing proteins typical of that cell type.

Reference is now made to FIGS. 5A and 5B which are schematic diagrams, which when taken together illustrate a "genomic records" concept of the conceptual model of the present invention, addressing the genomic differentiation enigma.

The Genomic Records concept asserts that the DNA (the thick recipe book in the illustration) comprises a very large number of Genomic Records (analogous to pages in the recipe book), each containing the instructions for differentiation of a different cell-type, or developmental process. Each Genomic Record is headed by a very short genomic sequence which functions as a "Genomic Address" of that Genomic Record (analogous to the page number in the recipe book). At its inception, in addition to the DNA, each cell also receives a short RNA segment (the scribbled note in the illustration). This short RNA segment binds complementarily to a "Genomic Address" sequence of one of the Genomic Records, thereby activating that Genomic Record, and accordingly determining the cell's-fate (analogous to opening the book on the page corresponding to the number on the scribbled note, thereby determining the meal to be prepared).

Referring to FIG. 5A, a CELL is illustrated which comprises a GENOME. The GENOME comprises a plurality of GENOMIC RECORDS, each of which correlates to a specific cell type (for clarity only 6 sample genomic records are shown). Each genomic record comprises genomic instructions on differentiation into a specific cell-type, as further elaborated below with reference to FIG. 7. At cell inception, the CELL receives a maternal short RNA segment, which activates one of the GENOMIC RECORDS, causing the cell to differentiate according to the instructions comprised in that genomic record. As an example, FIG. 5A illustrates reception of a maternal short RNA segment designated A" and outlined by a broken line, which activates the FIBRO genomic record, causing the cell to differentiate into a FIBROBLAST CELL.

Referring now to FIG. 5B, which is a simplified schematic diagram, illustrating cellular differentiation mediated by the "Genomic Records" concept. FIG. 5B depicts 2 cells in an organism, designated CELL A and CELL B, each having a GENOME. It is appreciated that since CELL A and CELL B are cells in the same organism, the GENOME of CELL A is identical to that of CELL B. Despite having an identical GENOME, CELL A differentiates differently from CELL B, due to activation of different genomic records in these two cells. In CELL A the FIBRO GENOMIC RECORD is activated, causing CELL A to differentiate into a FIBROBLAST CELL, whereas in CELL B the BONE GENOMIC RECORD is activated, causing the CELL B to differentiate into a BONE CELL. The cause for activation of different genomic records in these two cells is the different maternal short RNA which they both received: CELL A received a maternal short RNA segment designated A" which activated genomic record FIBRO, whereas CELL B received a maternal short RNA segment designated B" which activated genomic record BONE.

Reference is now made to FIG. 6 which is a schematic diagram illustrating a "genomically programmed cell differentiation" concept of the conceptual model of the present invention, addressing the genomic differentiation enigma.

A cell designated CELL A divides into 2 cells designated CELL B and CELL C. CELL A, CELL B and CELL C each comprise a GENOME, which GENOME comprises a plurality of GENOMIC RECORDS. It is appreciated that since CELL A, CELL B and CELL C are cells in the same organism, the GENOME of these cells, and the GENOMIC RECORDS comprised therein, are identical.

As described above with reference to FIG. 5B, at its inception, CELL A receives a maternal short RNA segment, designated A" and marked by a broken line, which activates the FIBRO genomic record, thereby causing CELL A to differentiate into a FIBROBLAST CELL. However, FIG. 6 shows further details of the genomic records: each cell genomic record also comprises two short genomic sequences, referred to here as Daughter Cell Genomic Addresses. Blocks designated B and C are Daughter Cell Genomic Addresses of the FIBRO Genomic Record. At cell division, each parent cell transcribes two short RNA segments, corresponding to the two Daughter Cell Genomic Addresses of the Genomic Record of that parent cell, and transfers one to each of its two daughter cells. CELL A of FIG. 6 transcribes and transfers to its two respective daughter cells, two short RNA segments, outlined by a broken line and designated B" and C", corresponding to daughter cell genomic addresses designated B and C comprised in the FIBRO genomic record.

CELL B therefore receives the above mentioned maternal short RNA segment designated B", which binds complementarily to genomic address designated B of genomic record BONE, thereby activating this genomic record, which in turn causes CELL B to differentiate into a BONE CELL. Similarly, CELL C receives the above mentioned maternal short RNA segment designated C", which binds complementarily to genomic address designated C of genomic record CARTIL., thereby activating this genomic record, which in turn causes CELL C to differentiate into a CARTILAGE CELL.

It is appreciated that the mechanism illustrated by FIG. 6 enables an unlimited lineage of cells to divide into daughter cells containing the same DNA, and to determine the cell-fate of these daughter cells. For example, when CELL B and CELL C divide into their respective daughter cells (not shown), they will transfer short RNA segments designated D" & E", and F" & G" respectively, to their respective daughter cells. The cell fate of each of these daughter cells would be determined by the identity of the maternal short RNA segment they receive, which would determine the genomic record activated.

Figure 7:
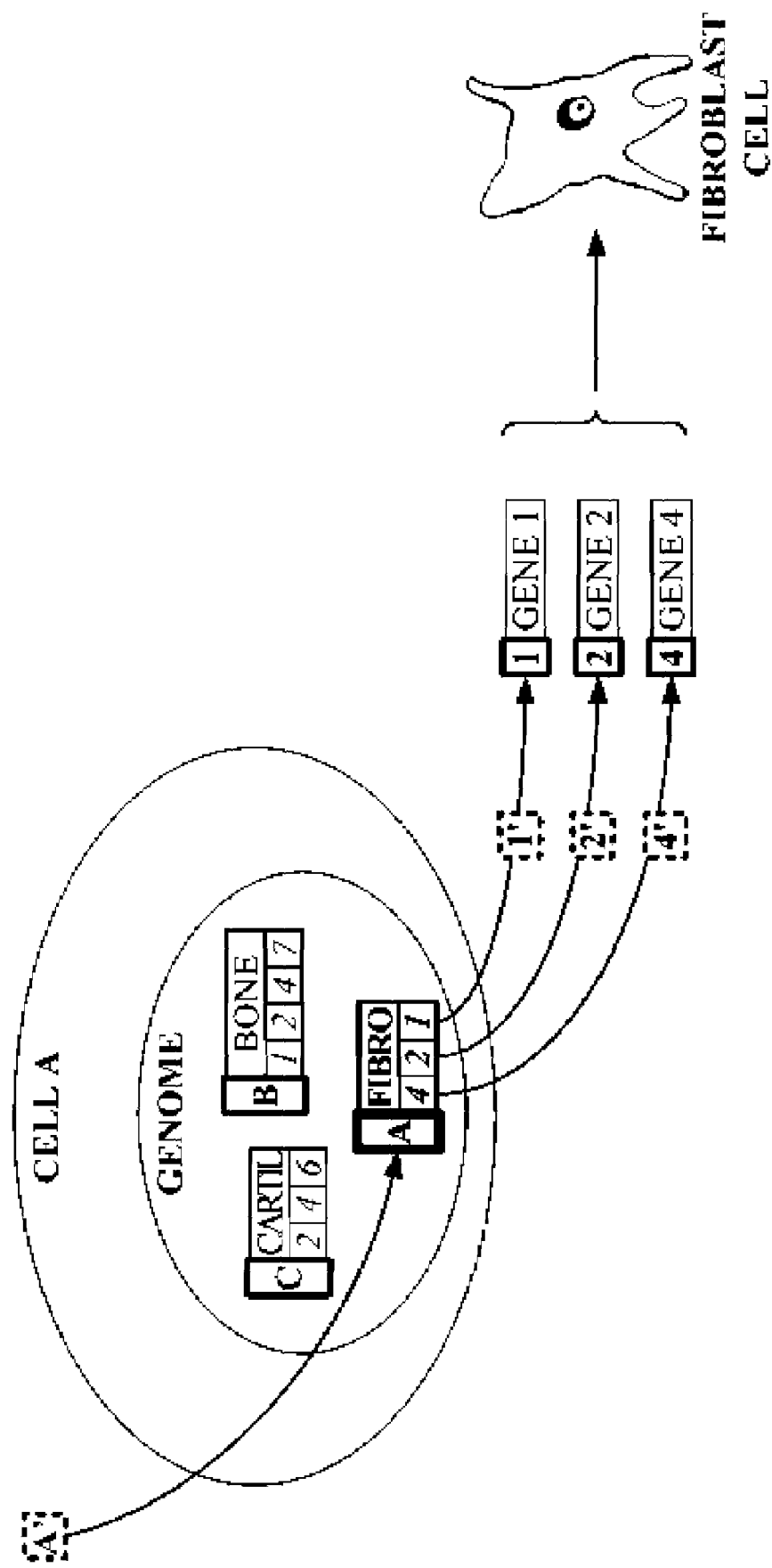
FIG. 7 is a schematic diagram illustrating a "genomically programmed cell-specific protein expression modulation" concept of the conceptual model of the present invention, addressing the genomic differentiation enigma.

Reference is now made to FIG. 7 which is a schematic diagram illustrating a "genomically programmed cell-specific protein expression modulation" concept of the conceptual model of the present invention, addressing the genomic differentiation enigma.

Cell A receives a maternal short RNA segment designated A", which activates a genomic record designated FIBRO, by anti-sense binding to a binding site "header" of this genomic record, designated A. Genomic record FIBRO encodes 3 short RNA segments, designated 1, 2 and 4 respectively, which modulate expression of target genes designated GENE1, GENE2 and GENE4 respectively. Modulation of expression of these genes results in CELL A differentiating into a FIBROBLAST CELL.

Figure 8:
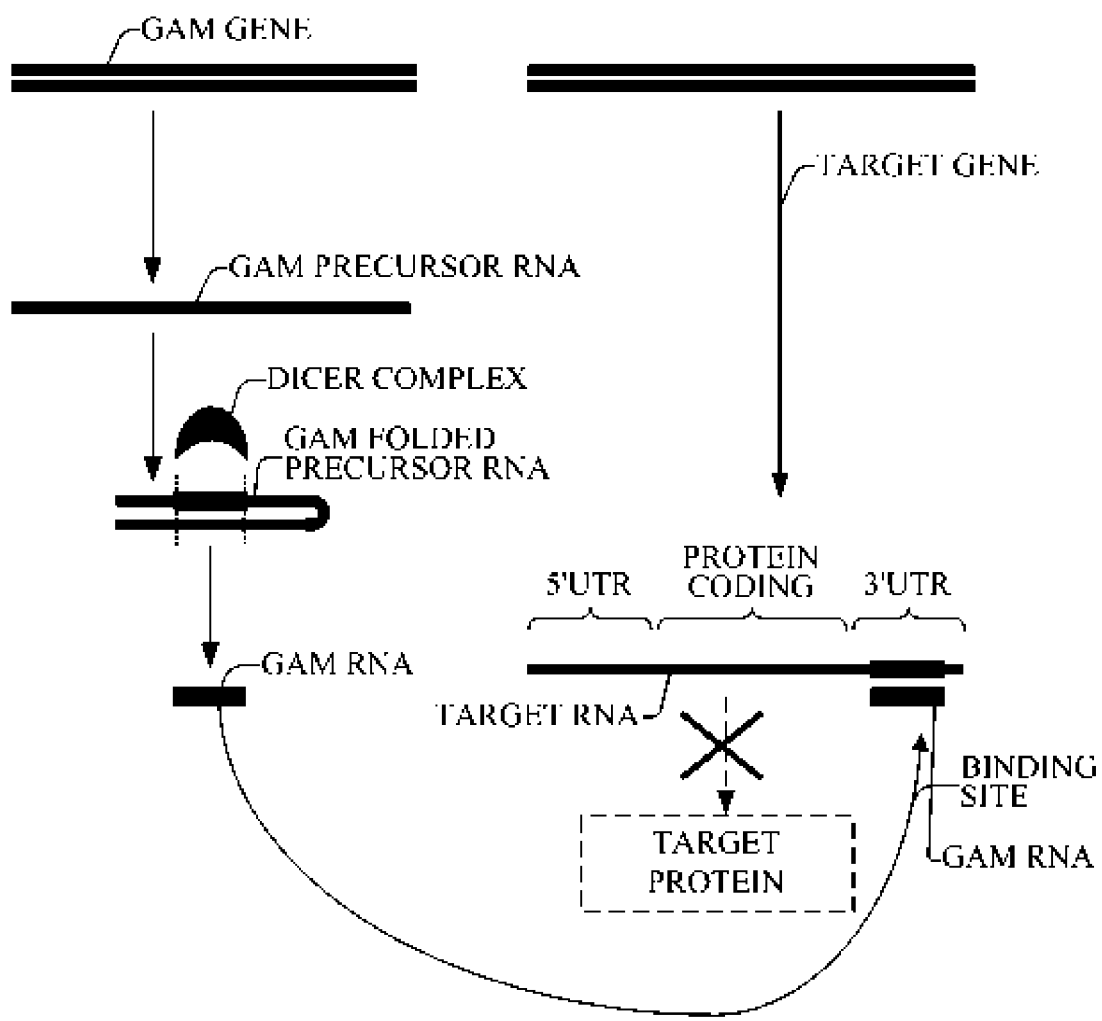
FIG. 8 is a simplified diagram illustrating a mode by which genes of a novel group of genes of the present invention, modulate expression of known target genes.

Reference is now made to FIG. 8 which is a simplified diagram illustrating a mode by which genes of a novel group of genes of the present invention, modulate expression of known target genes.

The novel genes of the present invention are micro RNA (miRNA)-like, regulatory RNA genes, modulating expression of known target genes. This mode of modulation is common to other known miRNA genes, as described hereinabove with reference to the background of the invention section.

GAM GENE and TARGET GENE are two human genes contained in the DNA of the human genome.

GAM GENE encodes a GAM PRECURSOR RNA. However, similar to other miRNA genes, and unlike most ordinary genes, its RNA, GAM PRECURSOR RNA, does not encode a protein.

GAM PRECURSOR RNA folds onto itself, forming GAM FOLDED PRECURSOR RNA. As FIG. 8 illustrates, GAM FOLDED PRECURSOR RNA forms a "hairpin structure", folding onto itself. As is well known in the art, this "hairpin structure", is typical genes of the miRNA genes, and is due to the fact that nucleotide sequence of the first half of the RNA of a gene in this group is an accurate or partial inversed-reversed sequence of the nucleotide sequence of its second half. By "inversed-reversed"is meant a sequence which is reversed and wherein each nucleotide is replaced by a complimentary nucleotide, as is well known in the art (e.g. ATGGC is the inversed-reversed sequence of GCCAT).

An enzyme complex, designated DICER COMPLEX, "dices" the GAM FOLDED PRECURSOR RNA into a single stranded RNA segment, about 22 nucleotides long, designated GAM RNA. As is known in the art, "dicing" of the hairpin structured RNA precursor into shorter RNA segments about 22 nucleotides long by a Dicer type enzyme is catalyzed by an enzyme complex comprising an enzyme called Dicer together with other necessary proteins.

TARGET GENE encodes a corresponding messenger RNA, designated TARGET RNA. This TARGET RNA comprises 3 regions: a 5" untranslated region, a protein coding region and a 3" untranslated region, designated 5"UTR, PROTEIN CODING and 3"UTR respectively.

GAM RNA binds complimentarily a BINDING SITE, located on the 3"UTR segment of TARGET RNA. This complimentarily binding is due to the fact that the nucleotide sequence of GAM RNA is an accurate or partial inversed-reversed sequence of the nucleotide sequence of BINDING SITE.

The complimentary binding of GAM RNA to BINDING SITE inhibits translation of TARGET RNA into TARGET PROTEIN. TARGET PROTEIN is therefore outlined by a broken line.

It is appreciated by one skilled in the art that the mode of transcriptional inhibition illustrated by FIG. 1 with specific reference to GAM genes of the present invention, is in fact common to all other miRNA genes. A specific complimentary binding site has been demonstrated only for Lin-4 and Let-7. All the other 93 newly discovered miRNA genes are also believed by those skilled in the art to modulate expression of other genes by complimentary binding, although specific complimentary binding sites for these genes have not yet been found (Ruvkun G., "Perspective: Glimpses of a tiny RNA world", Science 294, 779 (2001)). The present invention discloses a novel group of genes, the GAM genes, belonging to the miRNA genes group, and for which a specific an complimentary binding has been determined.

Figure 9:
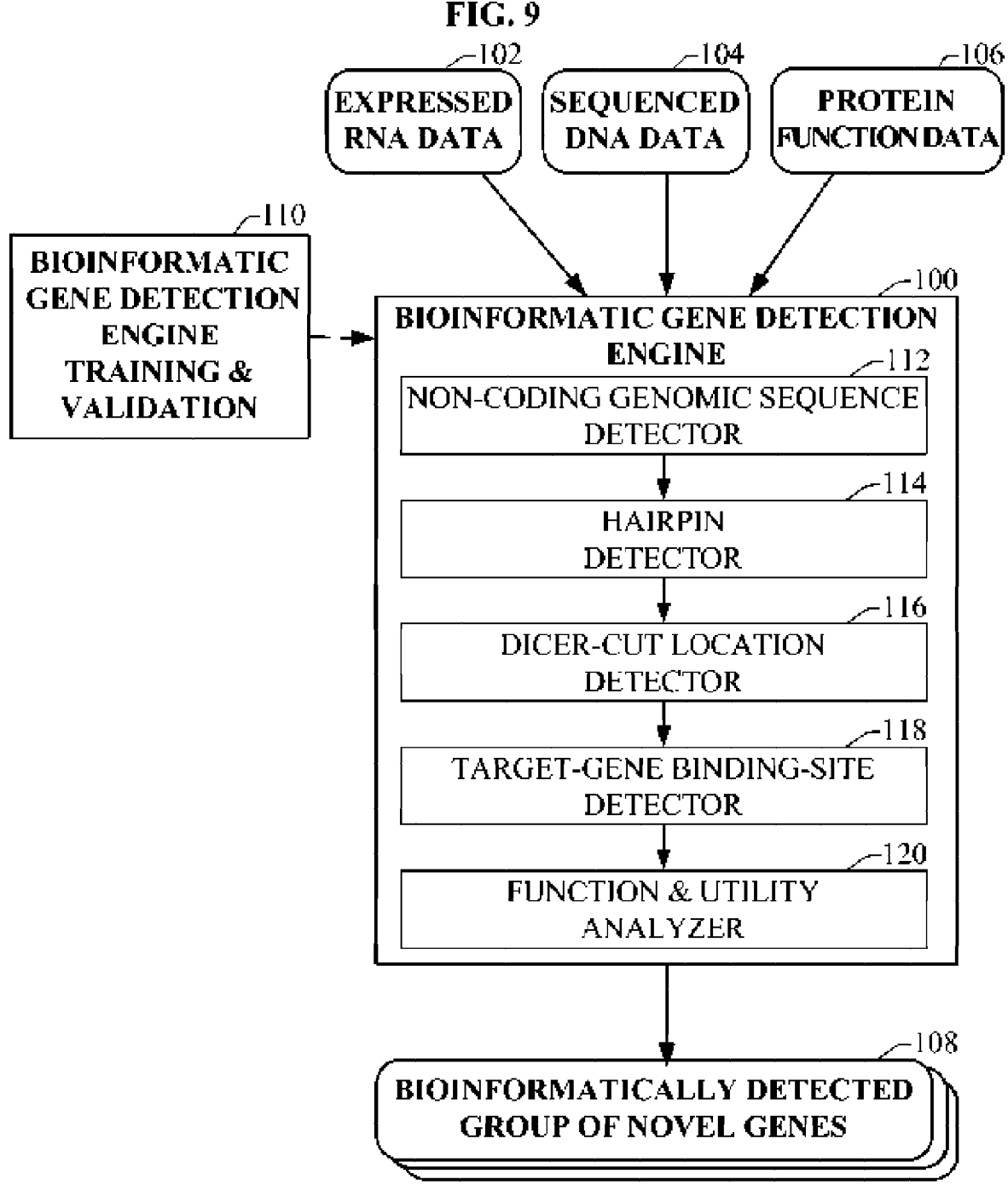
FIG. 9 is a simplified block diagram illustrating a bioinformatic gene detection system capable of detecting genes of the novel group of genes of the present invention, which system is constructed and operative in accordance with a preferred embodiment of the present invention.

Reference is now made to FIG. 9 which is a simplified block diagram illustrating a bioinformatic gene detection system capable of detecting genes of the novel group of genes of the present invention, which system is constructed and operative in accordance with a preferred embodiment of the present invention.

A bioinformatic gene detection engine 100, is a preferred implementation of a mechanism capable of detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102, sequenced DNA data 104 may preferably be obtained from data published by the National Center for Bioinformatics (NCBI) at the National Institute of Health (NIH), as well as from various other published data sources. Protein function data 106 may preferably be obtained from any one of numerous relevant published data sources, such as the Online Mendelian Inherited Disease In Man (OMIM) database developed by John Hopkins University, and also published by NCBI.

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further describe hereinbelow with reference to FIG. 10.

The bioinformatic gene detection engine 100 comprises several modules which are preferably activated sequentially, and are described as follows: A non-coding genomic sequence detector 112 operative to screen for and identify non-protein coding genomic sequences. The non-coding genomic sequence detector 112 is further described hereinbelow with reference to FIGS. 11A and 11B.

A hairpin detector 114 operative to locate genomic "hairpin-shaped" sequences, similar to GAM FOLDED PRECURSOR of FIG. 8. The hairpin detector 114 is further described hereinbelow with reference to FIGS. 12A and 12B.

A dicer-cut location detector 116 operative to detect the location on a hairpin shaped sequence which is enzymatically cut by DICER COMPLEX of FIG. 8. The dicer-cut location detector 116 is further described hereinbelow with reference to FIG. 13A.

A target-gene binding-site detector 118 operative to detect In these ESTs, the system locates "hairpin-shaped" (i.e. hairpin) sequences, which resemble known miRNA sequences. RNA 2D folding is calculated based on free-energy, using the Zucker algorithm (used throughout the process) [reference]. The 2D structure is then evaluated to locate hairpin structures, and meticulously compared to that of known miRNA genes.

A combined neural and Bayesian networks system is used to detect location in which the Dicer enzyme-complex is predicted to cut the final novel miRNA gene from the hairpin shaped gene-precursor. Nucleotide sequence, and "Bulges" (i.e. mismatches) on the hairpin shaped precursor, are represented as the input and output layers of several neural networks, and hidden layer/s are designed for these neural networks accordingly. The networks are trained, evaluated and validated based on the "training set" of 120 known miRNA genes, using accepted neural networks methodology; prediction is further optimized by integrating results of multiple networks [reference].

Potential target-gene binding-sites are detected, by comparison of the final-gene sequence, calculated above, to untranslated regions of known genes, followed by a comparison of the 2D structure and free-energy of the binding site to that of known miRNA binding sites.

Lastly, biological and clinical function of target genes, utilizing reference databases such as Johns Hopkins' OMIM [reference] is manually reviewed, and is compared to tissue-data of EST in which novel gene was detected.

Referring to FIG. 9, the following is a technical description of the computer hardware configuration which was used: Hardware and Software SetupComputing power presented a major challenge. Initial time estimates indicated that over 30 months (!) of computing time would be required to detect all miRNA genes in human EST data, and their respective binding sites, using a powerful 8-processor machine.

In order to address this challenge at reasonable cost, a system has been built which, comprises a cluster of one hundred PCs (Pentium IV, 1.7 GHz, with 40 GB storage each), connected by Ethernet to 4 servers (2-CPU, Xeon 2.2 GHz, with 200 GB storage each), combined with an 8-processor server (8-CPU, Xeon 550 Mhz w/ 8 GB RAM) connected via 2 HBA fiber-channels to an EMC Clariion 100-disks, 3.6 Terabyte storage device. FIG. 2 provides an overview of this hardware configuration.

Using this configuration, a database comprising 30 billion records was created, using Microsoft's SQL-Server database software, demonstrating remarkable performance results, including bulk insert of 1 million records in 0.8 seconds. To the best of our knowledge, this is the largest number-of-records database ever built on an Intel-machine, achieving unprecedented record-insert performance. The system has further been optimized such that all one hundred PCs run at 100% CPU usage continually. Using this configuration reduced the calculation time from 30 months to 20 days.

Figure 10:
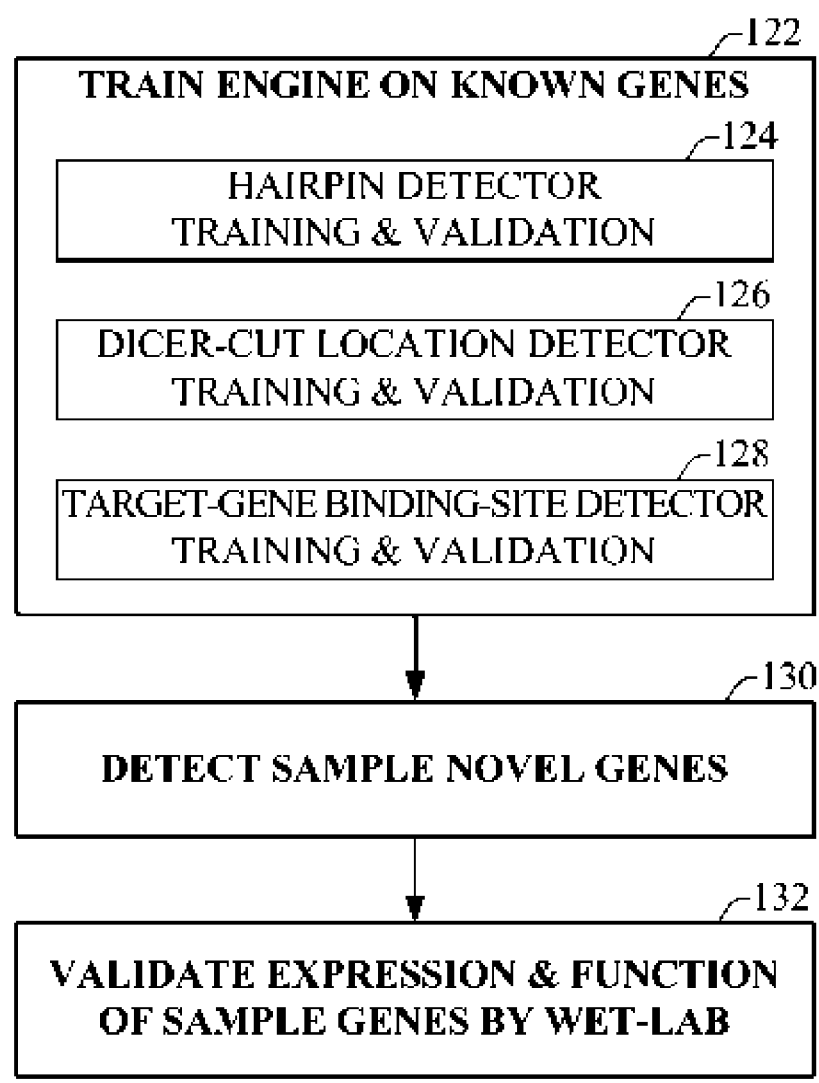
FIG. 10 is a simplified flowchart illustrating operation of a mechanism for training of a computer system to recognize the novel genes of the present invention, which mechanism is constructed and operative in accordance with a preferred embodiment of the present invention.

Reference is now made to FIG. 10 which is a simplified flowchart illustrating operation of a mechanism for training of a computer system to recognize the novel genes of the present invention. This mechanism is a preferred implementation of the bioinformatic gene detection engine training & validation 110 described hereinabove with reference to FIG. 9.

Figure 11A:
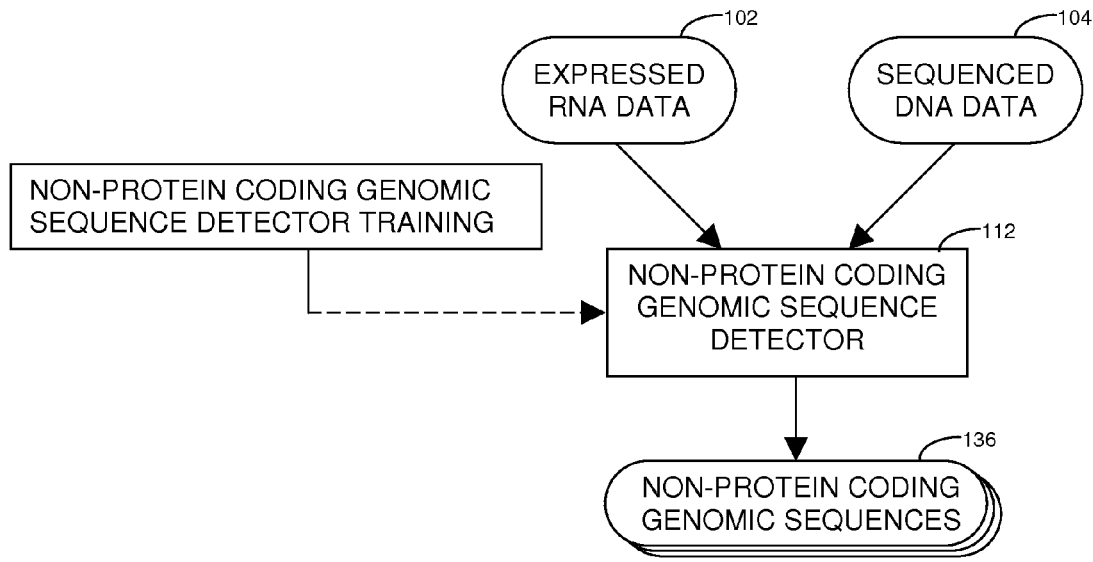
FIG. 11A is a simplified block diagram of a non-coding genomic sequence detector constructed and operative in accordance with a preferred embodiment of the present invention.

Reference is now made to FIG. 11A which is a simplified block diagram of a preferred implementation of the non-coding genomic sequence detector 112 described hereinabove with reference to FIG. 9.

Figure 11B:
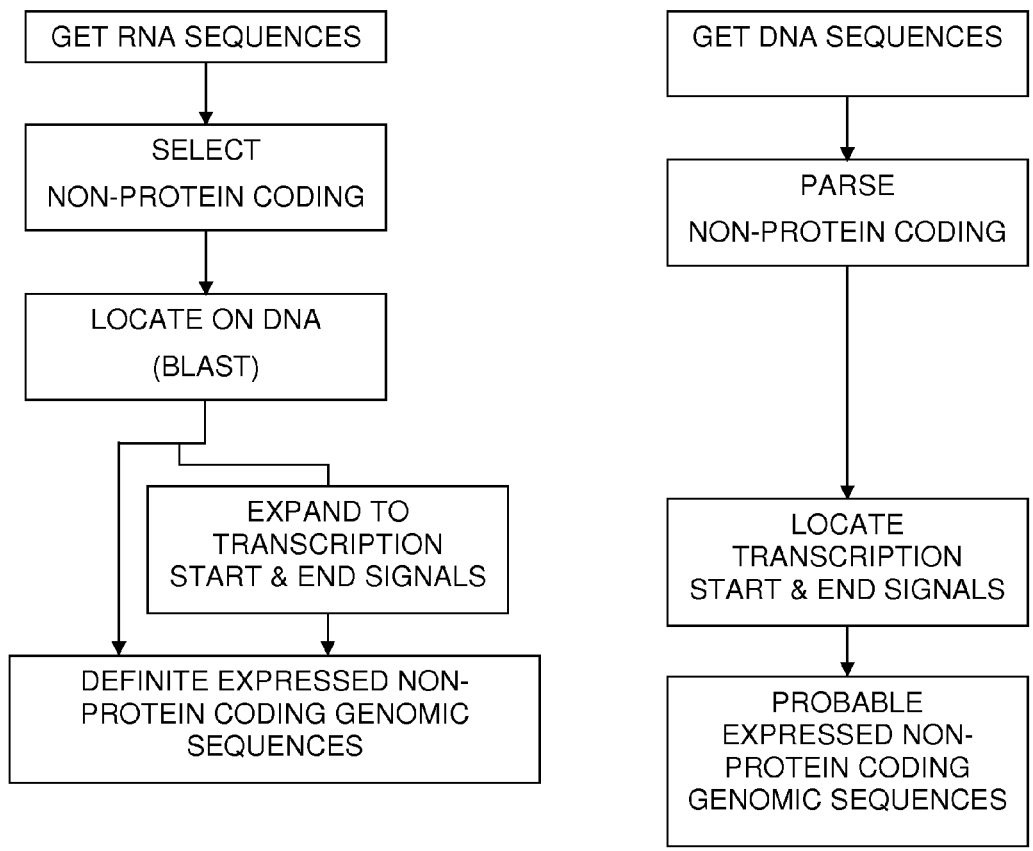
FIG. 11B is a simplified flowchart illustrating operation of a non-coding genomic sequence detector constructed and operative in accordance with a preferred embodiment of the present invention.

The system uses as input published genomic data, including expressed RNA data (EST data and mRNA data), sequenced DNA data, and protein function data, from NCBI. EST data is blast-compared [reference] to known protein coding sequences; only non-protein-coding ESTs are searched for novel RNA genes. Reference is now made to FIG. 11B which is a simplified flowchart illustrating a preferred operation of the non-coding genomic sequence detector 112 of FIG. 9.

Figure 12A:
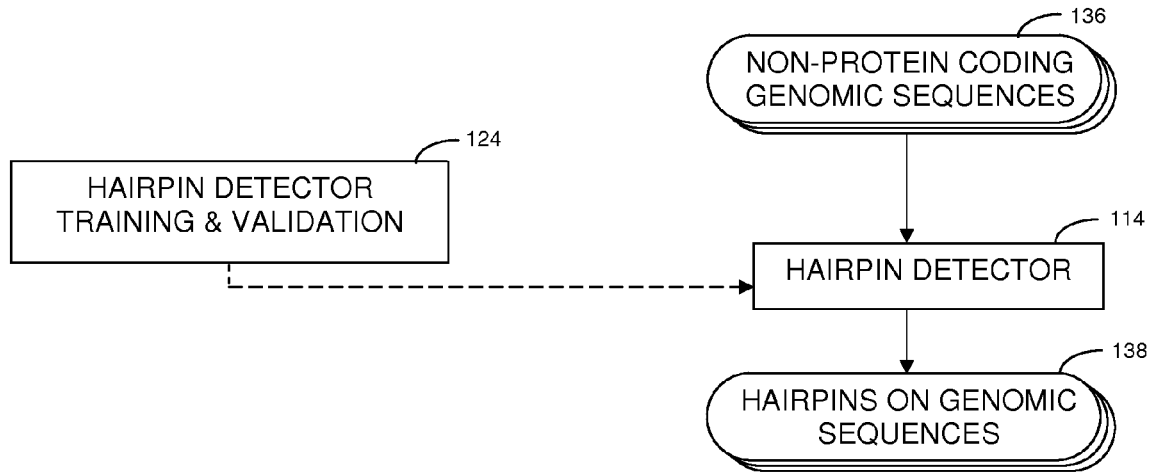
FIG. 12A is a simplified block diagram of a hairpin detector constructed and operative in accordance with a preferred embodiment of the present invention.

Reference is now made to FIG. 12A which is a simplified block diagram of a preferred implementation of the hairpin detector 114 described hereinabove with reference to FIG. 9.

Figure 12B:
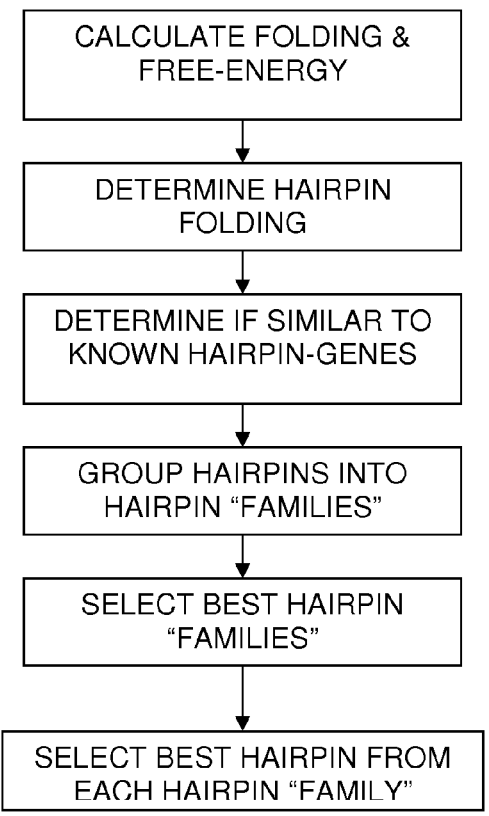
FIG. 12B is a simplified flowchart illustrating operation of a hairpin detector constructed and operative in accordance with a preferred embodiment of the present invention.

Reference is now made to FIG. 12B which is a simplified flowchart illustrating a preferred operation of the hairpin detector 114 of FIG. 9.

Figure 13A:
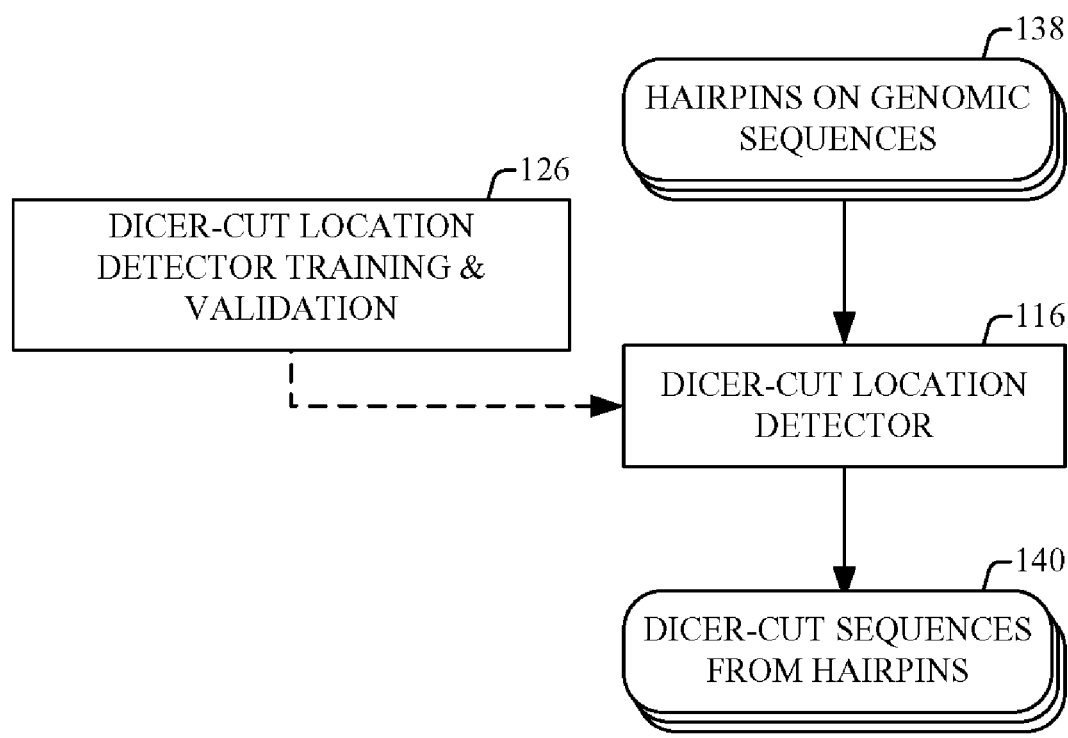
FIG. 13A is a simplified block diagram of a dicer-cut location detector constructed and operative in accordance with a preferred embodiment of the present invention.

Reference is now made to FIG. 13A which is a simplified block diagram of a preferred implementation of the dicer-cut location detector 116 described hereinabove with reference to FIG. 9.

Figure 13B:
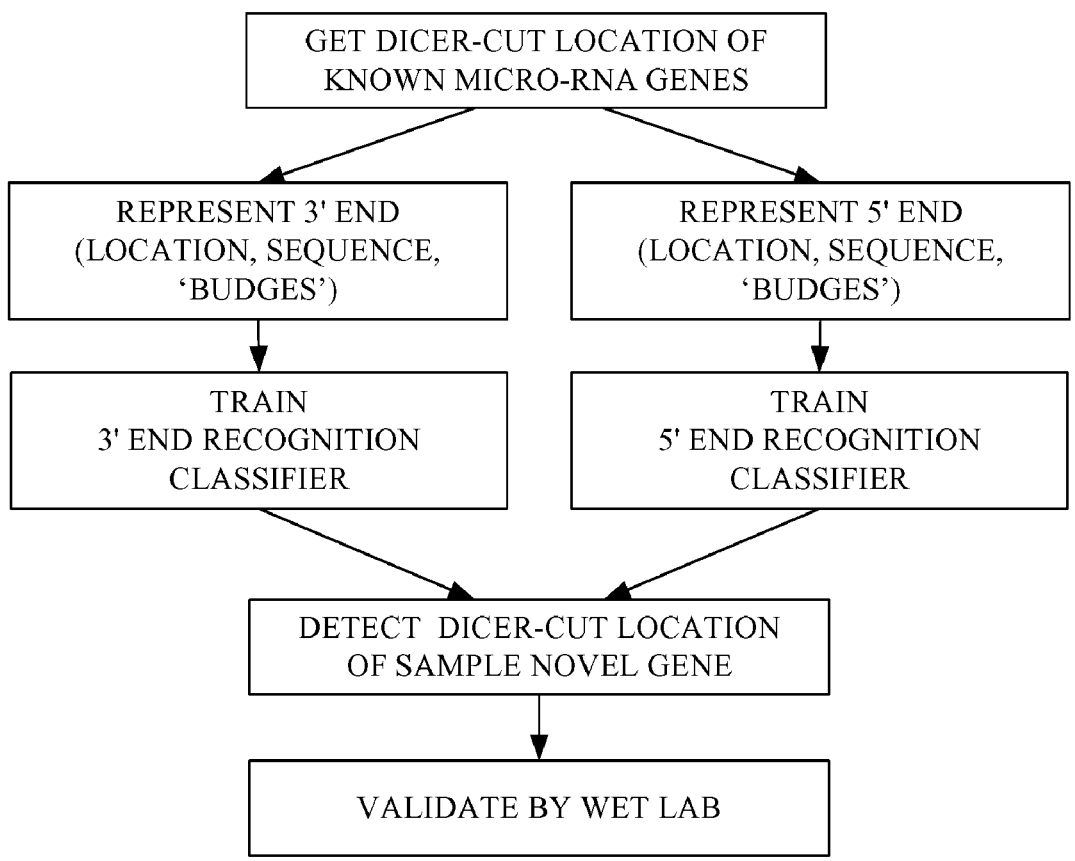
FIG. 13 B is a simplified flowchart illustrating training of a dicer-cut location detector constructed and operative in accordance with a preferred embodiment of the present application.
FIG. 13C is a simplified flowchart illustrating operation of a dicer-cut location detector constructed and operative in accordance with a preferred embodiment of the present invention.
Figure 13C:
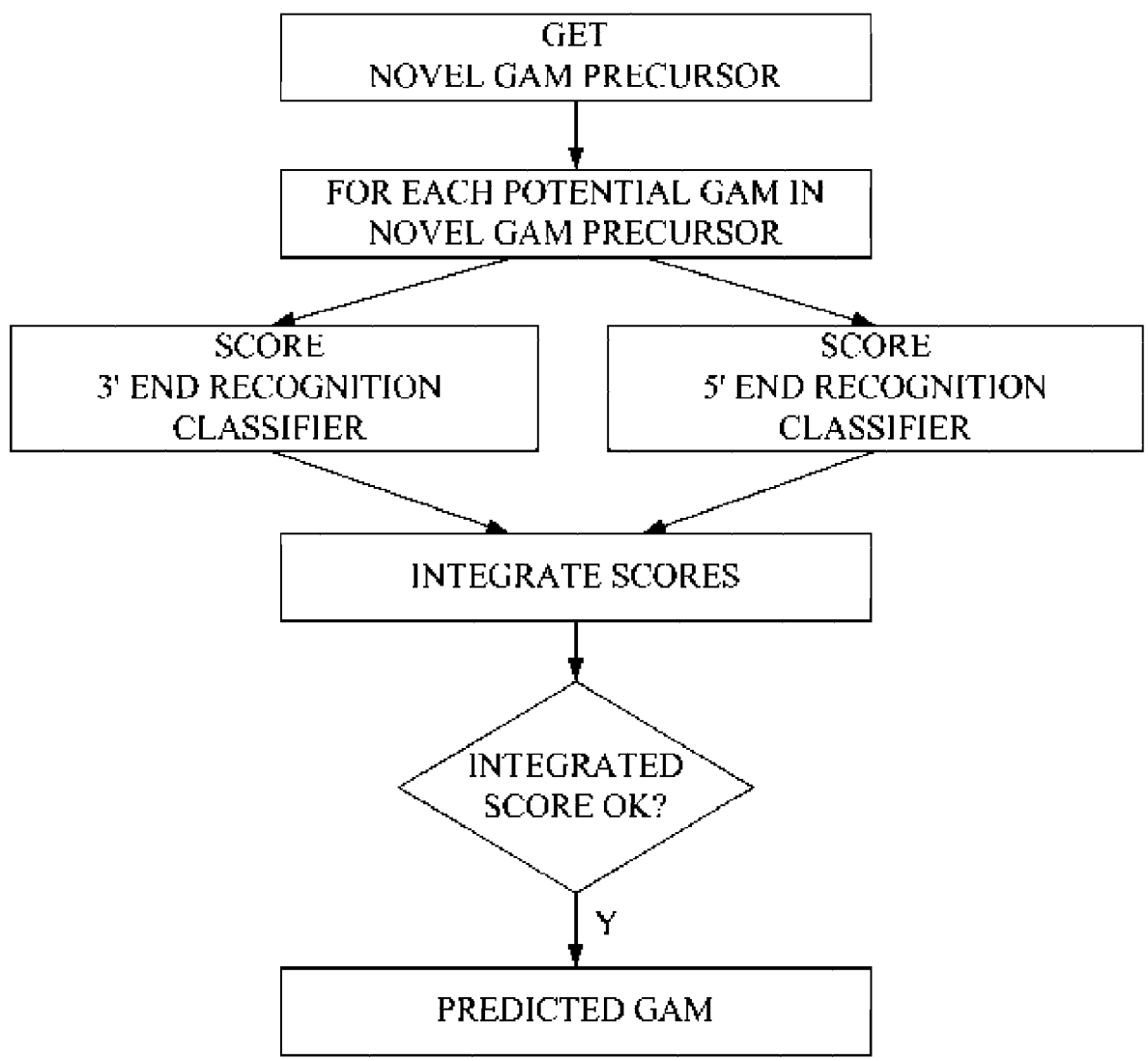

Reference is now made to FIG. 13B which is a simplified flowchart illustrating a preferred implementation of dicer-cut location detector training & validation 126 of FIG. 10.

Figure 14A:
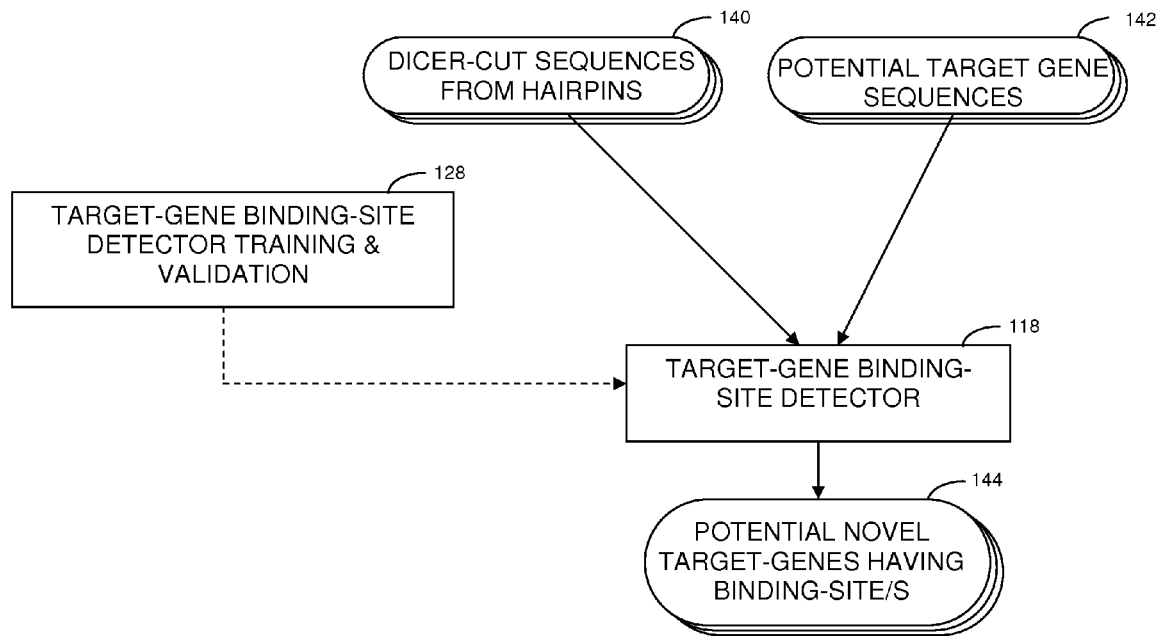
FIG. 14A is a simplified block diagram of a target-gene binding-site detector constructed and operative in accordance with a preferred embodiment of the present invention.

Reference is now made to FIG. 14A which is a simplified block diagram of a preferred implementation of the target-gene binding-site detector 118 described hereinabove with reference to FIG. 9.

Figure 14B:
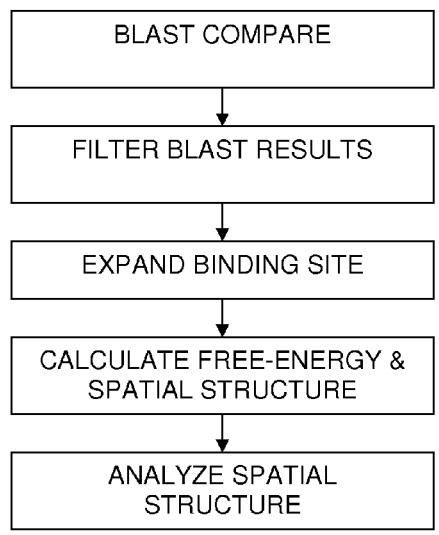
FIG. 14B is a simplified flowchart illustrating operation of a target-gene binding-site detector constructed and operative in accordance with a preferred embodiment of the present invention.

Reference is now made to FIG. 14B which is a simplified flowchart illustrating a preferred operation of the target-gene binding-site detector 118 of FIG. 9.

Figure 15:
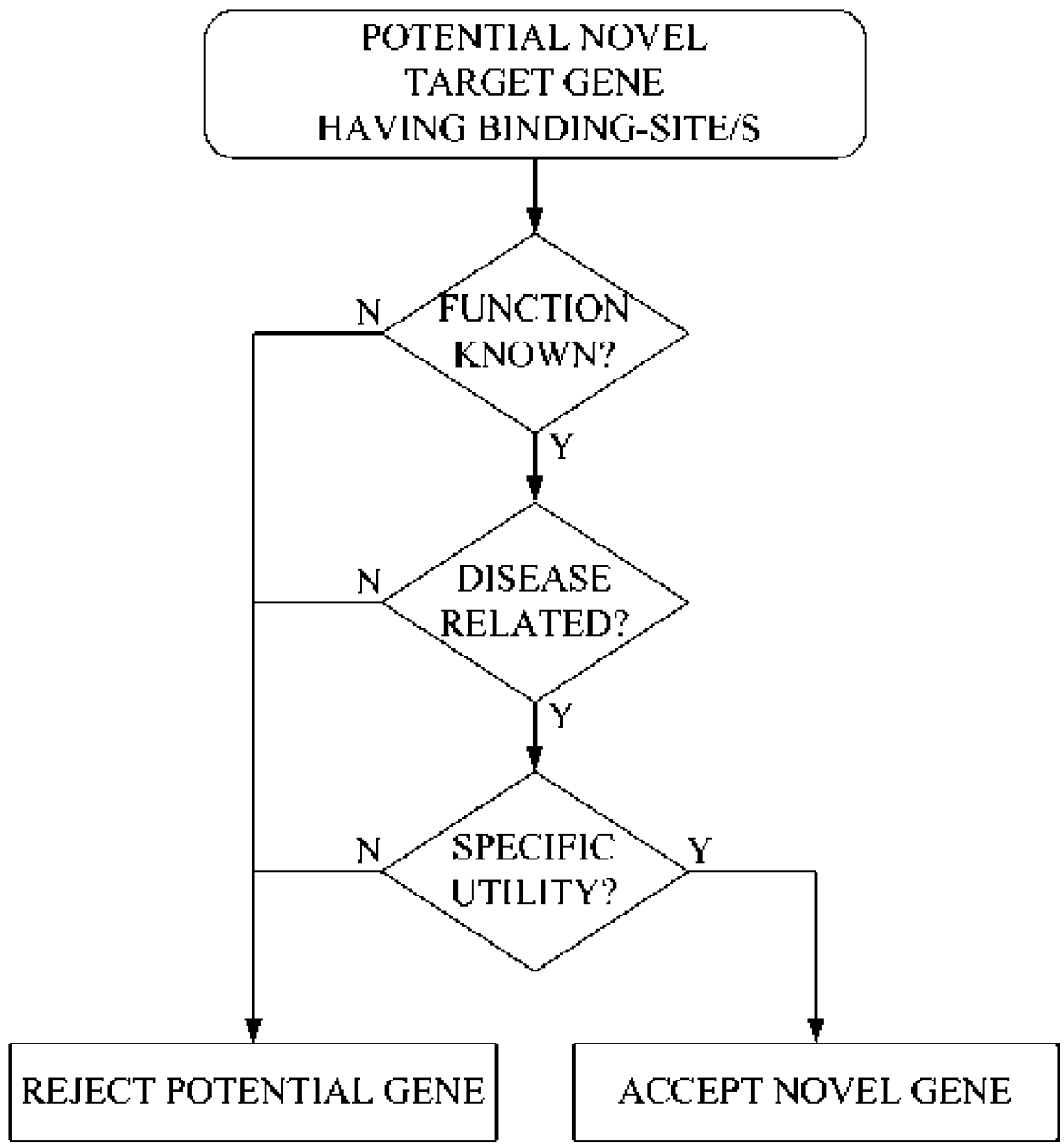
FIG. 15 is a simplified flowchart illustrating operation of a function & utility analyzer constructed and operative in accordance with a preferred embodiment of the present invention.
Figure 16:
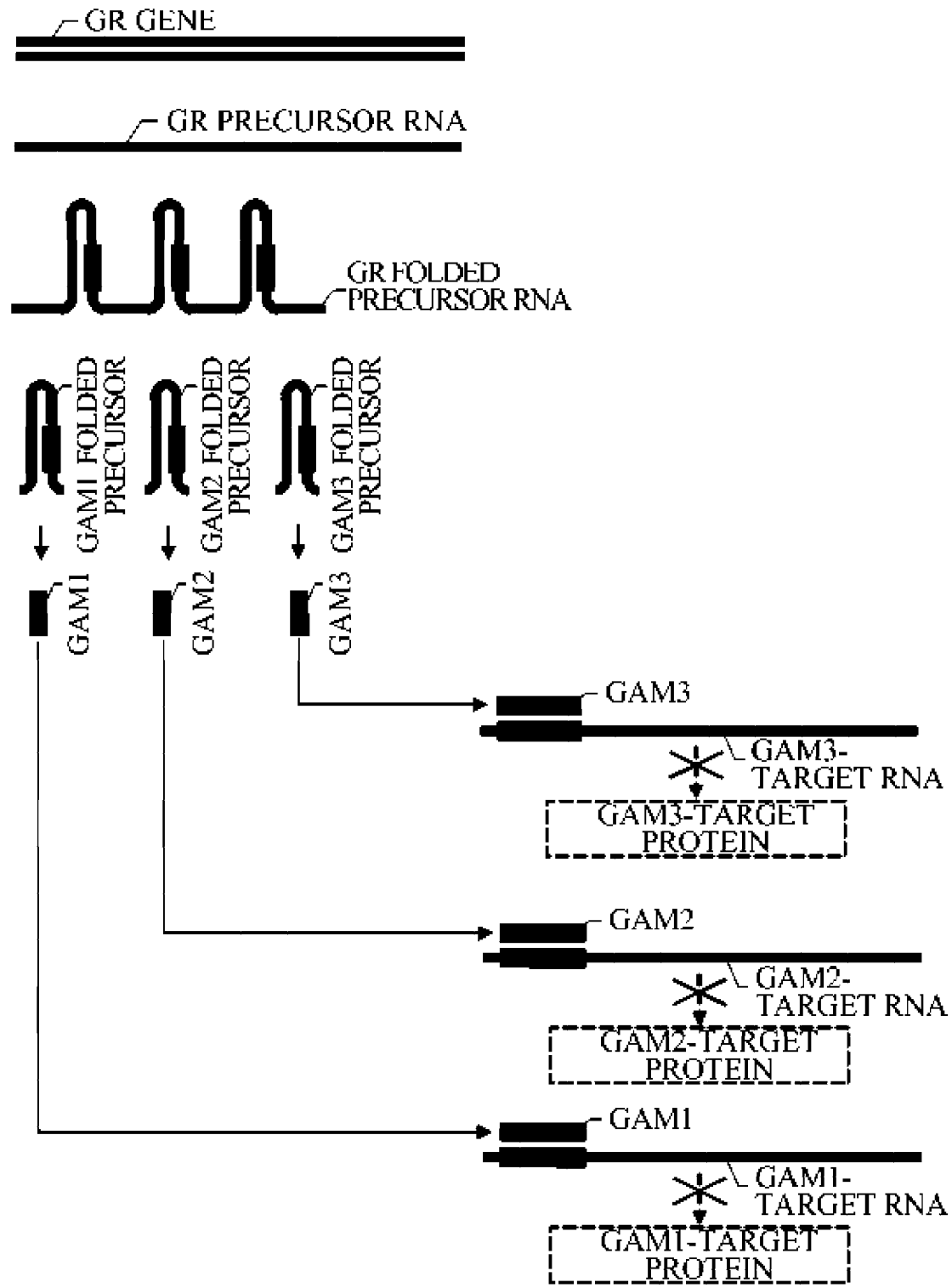
FIG. 16 is a simplified diagram describing a novel bioinformatically detected group of regulatory genes, referred to here as Genomic Record (GR) genes, each of which encodes an "operon-like" cluster of novel miRNA-like genes, which in turn modulates expression of a plurality of target genes.
Figure 17:
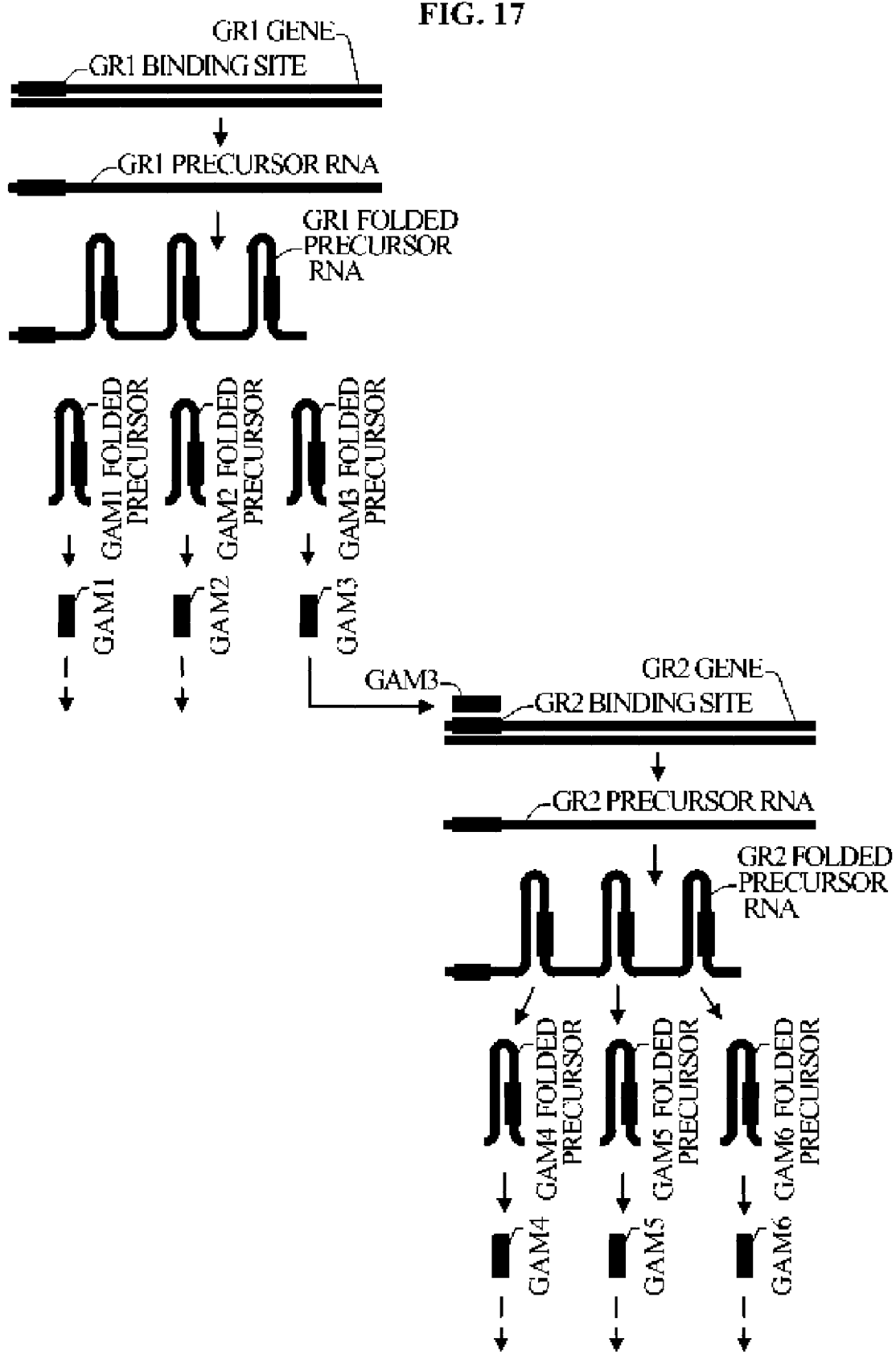
FIG. 17 is a simplified diagram illustrating a mode by which genes of a novel group of operon-like genes of the present invention, modulate expression of other such genes, in a cascading manner.
Figure 18:
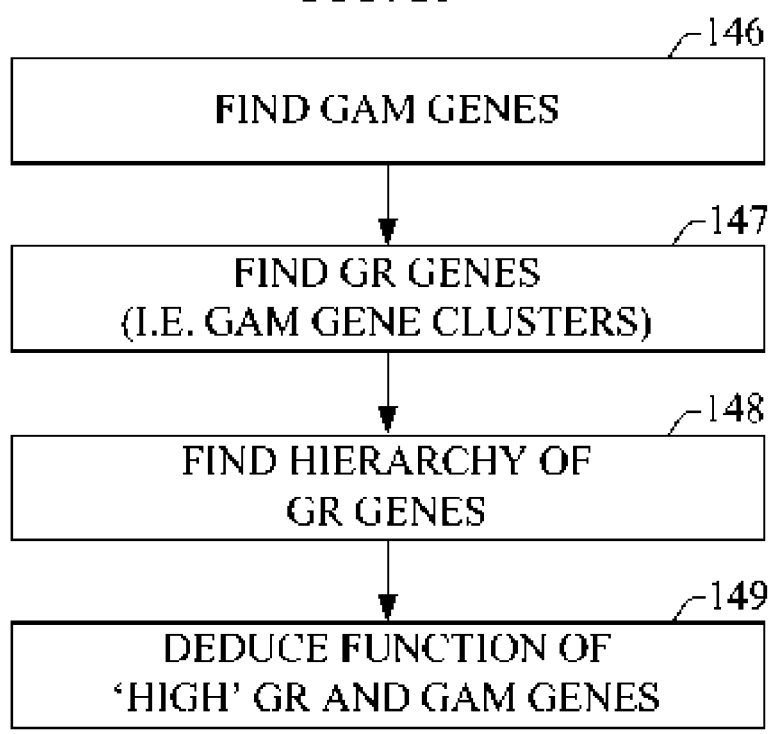
FIG. 18 is a block diagram illustrating an overview of a methodology for finding novel genes and operons of the present invention, and their respective functions.
Figure 19:
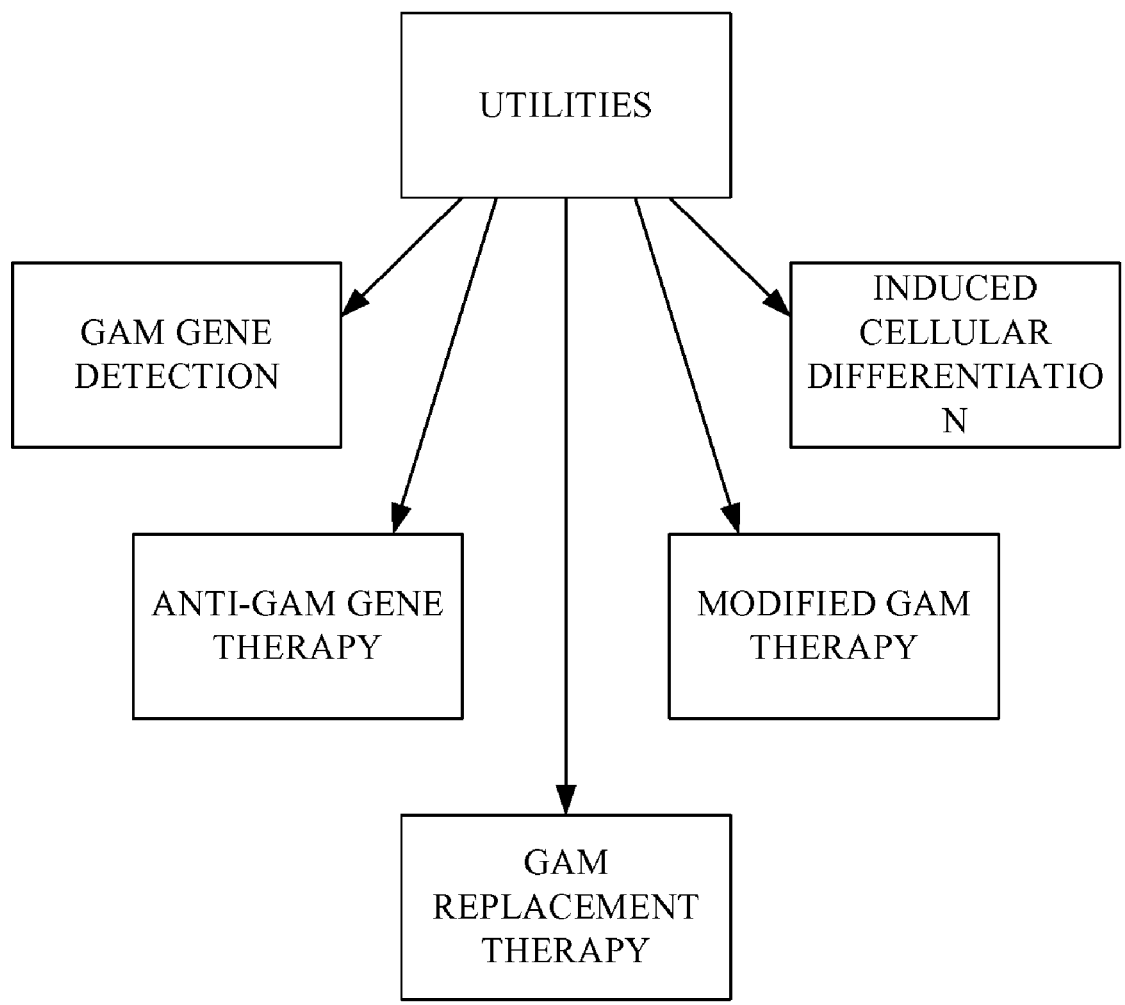
FIG. 19 is a block diagram illustrating different utilities of genes of a novel group of genes, and operons of a novel group of operons, both of the present invention.
Figure 22C:
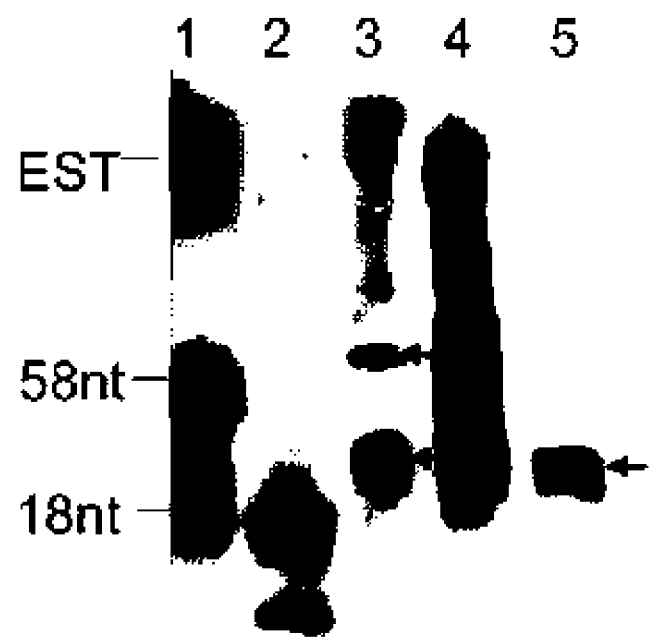
FIG. 22C is a picture of laboratory results, which confirm endogenous expression of bioinformatically detected novel gene GAM25 of FIG. 22A.

Reference is now made to FIG. 15 which is a simplified flowchart illustrating a preferred operation of the function & utility analyzer 120 described hereinabove with reference to FIG. 9.

Reference is now made to FIG. 21A which is an annotated sequence of an EST comprising a novel gene detected by the gene detection system of the present invention. FIG. 21A shows the nucleotide sequence of a known human non-protein coding EST (Expressed Sequence Tag), identified as EST72223. It is appreciated that the sequence of this EST comprises sequences of one known miRNA gene, identified as MIR98, and of one novel GAM gene, referred to here as GAM-4, detected by the bioinformatic gene detection system of the present invention, described hereinabove with reference to FIG. 9.

Reference is now made to FIGS. 21B-21D that are pictures of laboratory results, which when taken together demonstrate laboratory confirmation of expression of the bioinformatically detected novel gene of FIG. 21A.

Referring to FIG. 21B which is a Northern blot analysis of MIR-98 and EST72223 transcripts. MIR-98 and EST72223 were reacted with MIR-98 and GAM-4 probes as indicated in the figure. It is appreciated that the probes of both MIR-98 and GAM-4 reacted with EST72223, indicating that EST72223 contains the sequences of MIR-98 and of GAM-4. It is further appreciated that the probe of GAM-4 did not cross-react with MIR-98.

With reference to FIG. 21B, a Northern blot analysis of EST72223 and MIR-98 transfections were performed, subsequently marking RNA by the MIR-98 and GAM-4 probes. Left, Northern reacted with MIR-98, Right, Northern reacted with GAM-4. The molecular Sizes of EST72223, MIR-98 and GAM-4 are indicated by arrows. Hela are control cells that have not been introduced to exogenous RNA. EST and MIR-98 Transfections are RNA obtained from Hela transfected with EST72223 and MIR-98, respectively. MIR-98 and EST are the transcripts used for the transfection experiment. The results indicate that EST72223, when transfected into Hela cells, is cut yielding known miRNA gene MIR-98 and novel miRNA gene GAM-4.

Referring to FIGS. 21A and 21B, the following technical methods used are specified as follows: Transcript preparations: Digoxigenin (DIG) labeled transcripts were prepared from EST72223 (TIGER), MIR98 and predicted precursor hairpins by using a DIG RNA labeling kit (Roche Molecular Biochemicals) according to the manufacturer's protocol. Briefly, PCR products with T7 promoter at the 5" end or T3 promoter at the 3" end were prepared from each DNA in order to use it as a template to prepare sense and antisense transcripts, respectively.

MIR-98 was amplified using EST72223 as a template with T7miR98 forward primer: 5-"TAATACGACTCACTAT-AGGGTGAGGTAGTAAGTTGTATTGTT-3" (SEQ ID NO: 8791) and T3miR98 reverse primer: 5"-AATTAACCCT-CACTAAAGGGAAAGTAGTAAGTTGTATAGTT-3" (SEQ ID NO: 8792). EST72223 was amplified with T7-EST 72223 forward primer: 5"-TAATACGACTCACTATAGGCCCT-TATTAGAGGATTCTGCT-3" (SEQ ID NO: 8793) and T3-EST72223 reverse primer: 5"-AATTAACCCTCAC-TAAAGGTTTTTTTTTCCTGAGACAGAGT-3" (SEQ ID NO: 8794). Bet-4 was amplified using EST72223 as a template with Bet-4 forward primer: 5"-GAGGCAGGAGAAT-TGCTTGA-3" (SEQ ID NO: 8795) and T3-EST72223 reverse primer: 5"-AATTAACCCTCACTAAAGGCCT-GAGACAGAGTCTTGCTC-3" (SEQ ID NO: 8796). The PCR products were cleaned and used for DIG-labeled or unlabeled transcription reactions with the appropriate polymerase. For transfection experiments, CAP reaction was performed by using a mMessage mMachine kit (Ambion).

Transfection procedure: Transfection of Hela cells was performed by using TransMessenger reagent (Qiagen) according to the manufacture's protocol. Briefly, Hela cells were seeded to 1-2×10^6 cells per plate a day before transfection. Two μg RNA transcripts were mixed with 8 μl Enhancer in a final volume of 100 μl, mixed and incubated at room temperature for 5 min. 16 μl TransMessenger reagent was added to the RNA-Enhancer, mixed and incubated for additional 10 min. Cell plates were washed with sterile PBS twice and then incubated with the transfection mix diluted with 2.5 ml DMEM medium without serum. Cells were incubated with transfection mix for three hours under their normal growth condition (370C and 5% CO2) before the transfection mix was removed and a fresh DMEM medium containing serum was added to the cells. Cells were left to grow 48 hours before harvesting.

Northern analysis: RNAs were extracted from cells by using Tri-reagent according to the manufacture's protocol. The RNAs were dissolved in water and heated to 650C to disrupt any association of the 25 nt RNA with larger RNA molecules. RNA were placed on ice and incubated for 30 min with PEG (MW=8000) in a final concentration of 5% and NaCl in a final concentration of 0.5M to precipitate high molecular weight nucleic acid. The RNAs were centrifuged at 10,000×g for 10 min to pellet the high molecular weight nucleic acid. The supernatant containing the low molecular weight RNAs was collected and three volumes of ethanol was added. The RNAs were placed at −200C for at least two hours and then centrifuged at 10,000×g for 10 min. The pellets were dissolved in Urea-TBE buffer (1×tbe, 7M urea) for further analysis by a Northern blot.

RNA samples were boiled for 5 min before loading on 15%-8% polyacrylamide (19:1) gels containing 7M urea and 1×TBE. Gels were run in 1×TBE at a constant voltage of 300V and then transferred into a nylon membrane. The membrane was exposed to 3 min ultraviolet light to cross link the RNAs to the membrane. Hybridization was performed overnight with DIG-labeled probes at 420C. Membranes were washed twice with SSC×2 and 0.2% SDS for 10 min. at 420C and then washed twice with SSC×0.5 for 5 min at room temperature. The membrane was then developed by using a DIG luminescent detection kit (Roche) using anti DIG and CSPD reaction, according to the manufacture's protocol.

Reference is now made to FIG. 8, which is a simplified diagram describing each of a plurality of novel bioinformatically detected genes of the present invention, referred to here as Genomic Address Messenger (GAM) genes, which modulates expression of respective target genes thereof, the function and utility of which target genes is known in the art.

GAM is a novel bioinformatically detected regulatory, non protein coding, micro RNA (miRNA) gene. The method by which GAM was detected is described hereinabove with reference to FIGS. 2-8.

GAM GENE and GAM TARGET GENE are human genes contained in the human genome.

GAM GENE encodes a GAM PRECURSOR RNA. Similar to other miRNA genes, and unlike most ordinary genes, GAM PRECURSOR RNA does not encode a protein.

GAM PRECURSOR RNA folds onto itself, forming GAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By inversed-reversed is meant a sequence which is reversed and wherein each nucleotide is replaced by a complementary nucleotide, as is well known in the art (e.g. ATGGC is the inversed-reversed sequence of GCCAT).

An enzyme complex designated DICER COMPLEX, dices the GAM FOLDED PRECURSOR RNA into GAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins.

GAM TARGET GENE encodes a corresponding messenger RNA, GAM TARGET RNA. GAM TARGET RNA comprises three regions, as is typical of mRNA of a protein coding gene: a 5 untranslated region, a protein coding region and a 3 untranslated region, designated 5UTR, PROTEIN CODING and 3UTR respectively.

GAM RNA binds complementarily to one or more target binding sites located in untranslated regions of GAM TARGET RNA. This complementary binding is due to the fact that the nucleotide sequence of GAM RNA is an accurate or a partial inversed-reversed sequence of the nucleotide sequence of each of the target binding sites. As an illustration, FIG. 8 shows 3 such target binding sites, designated BINDING SITE I, BINDING SITE II and BINDING SITE III respectively. It is appreciated that the number of target binding sites shown in FIG. 8 is meant as an illustration only, and is not meant to be limiting GAM RNA may have a different number of target binding sites in untranslated regions of a GAM TARGET RNA. It is further appreciated that while FIG. 8 depicts target binding sites in the 3UTR region, this is meant as an example only these target binding sites may be located in the 3UTR region, the 5UTR region, or in both 3UTR and 5UTR regions.

The complementary binding of GAM RNA to target binding sites on GAM TARGET RNA, such as BINDING SITE I, BINDING SITE II and BINDING SITE III, inhibits translation of GAM TARGET RNA into GAM TARGET PROTEIN. GAM TARGET PROTEIN is therefore outlined by a broken line.

It is appreciated that GAM TARGET GENE in fact represents a plurality of GAM target genes. The mRNA of each one of this plurality of GAM target genes comprises one or more target binding sites, each having a nucleotide sequence which is at least partly complementary to GAM RNA, and which when bound by GAM RNA causes inhibition of translation of respective one or more GAM target proteins.

It is further appreciated by one skilled in the art that the mode of translational inhibition illustrated by FIG. 8 with specific reference to translational inhibition exerted by GAM GENE on one or more GAM TARGET GENE, is in fact common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294,779 (2001)).

It is yet further appreciated that specific functions, and accordingly utilities, of GAM correlate with, and may be deduced from, the identity of the target genes which GAM binds and inhibits, and the function of these target genes, as elaborated hereinbelow.

Nucleotide sequences of the GAM PRECURSOR RNA, and of the diced GAM RNA, and a schematic representation of the secondary folding of GAM FOLDED PRECURSOR RNA of each of the plurality of GAM GENEs described by FIG. 8 are further described hereinbelow with reference to Table.

Nucleotide sequences of target binding sites, such as BINDING SITE-I, BINDING SITE-II and BINDING SITE-III of FIG. 8, found on, and schematic representation of the complementarity of each of these target binding sites to GAM RNA are described hereinbelow with reference to Table.

The Genomic Record 672 (GR672) gene encodes an operon-like cluster of novel micro RNA-like genes, each of which in turn modulates expression of at least one target gene, the function and utility of which at least one target gene is known in the art.

GR672 GENE is a novel bioinformatically detected regulatory, non protein coding, RNA gene. The method by which GR672 GENE was detected is described hereinabove with reference to FIGS. 6-15.

GR672 GENE encodes GR672 PRECURSOR RNA, an RNA molecule, typically several hundred nucleotides long.

GR672 PRECURSOR RNA folds spatially, forming GR672 FOLDED PRECURSOR RNA. It is appreciated that GR672 FOLDED PRECURSOR RNA comprises a plurality of what is known in the art as hairpin structures. These hairpin structures are due to the fact that the nucleotide sequence of GR672 PRECURSOR RNA comprises a plurality of segments, the first half of each such segment having a nucleotide sequence which is at least a partial inversed-reversed sequence of the second half thereof, as is well known in the art.

GR672 FOLDED PRECURSOR RNA is naturally processed by cellular enzymatic activity into at least 2 separate GAM precursor RNAs, GAM334 PRECURSOR and GAM390 PRECURSOR, each of which GAM precursor RNAs being a hairpin shaped RNA segment, corresponding to GAM PRECURSOR RNA of FIG. 8.

The above mentioned GAM precursor RNAs are diced by DICER COMPLEX of FIG. 8, yielding respective short RNA segments of about 22 nucleotides in length, GAM334 RNA and GAM390 RNA respectively, each of which GAM RNAs corresponding to GAM RNA of FIG. 8.

GAM334 RNA binds complementarily to a target binding site located in an untranslated region of a GAM334 target RNA, thereby inhibiting translation of a GAM334 target RNA into a GAM334 target protein.

GAM390 RNA binds complementarily to a target binding site located in an untranslated region of a GAM390 target RNA, thereby inhibiting translation of a GAM390 target RNA into a GAM390 target protein.

It is appreciated that specific functions, and accordingly utilities, of the GR672 gene correlate with, and may be deduced from, the identity of the target genes, which are inhibited by GAM RNAs comprised in the operon-like cluster of the GR672 gene: GAM334 target protein and GAM390 target protein. The function of these target genes is elaborated hereinabove with reference to Table 1 and Table 2.

---

LENGTHY TABLES

The patent contains a lengthy table section. A copy of the table is available in electronic form from the USPTO web site (http://seqdata.uspto.gov/?pageRequest=docDetail&DocID=US08039608B1). An electronic copy of the table will also be available from the USPTO upon request and payment of the fee set forth in 37 CFR 1.19(b)(3).

---

SEQUENCE LISTING (8797 sequences)

SEQ ID NO: 1 - RNA, 68 nt, Homo Sapiens
gaggcggguggaucaccugaggucaggaguucgagaccaaccuggccaacacggcgaaaccccgccuc

SEQ ID NO: 2 - RNA, 24 nt, Homo Sapiens
aaccuggccaacacggcgaaaccc

SEQ ID NO: 3 - RNA, 22 nt, Homo Sapiens
ccuggccaacauggugaaaccc

SEQ ID NO: 4 - RNA, 58 nt, Homo Sapiens
ucagagugaacaggcaaccuacaaaaugggagaaaauuuucgcaaccuacucaucuga

SEQ ID NO: 5 - RNA, 24 nt, Homo Sapiens
ugaacaggcaaccuacaaaauggg

SEQ ID NO: 6 - RNA, 22 nt, Homo Sapiens
aauagccacagcaacaaaaugg

SEQ ID NO: 7 - RNA, 20 nt, Homo Sapiens
aacagagaacccuacaaaau

SEQ ID NO: 8 - RNA, 19 nt, Homo Sapiens
aacaggcaaauagcaaaau

SEQ ID NO: 9 - RNA, 20 nt, Homo Sapiens
aaaaagcaaaauacaaaaug

SEQ ID NO: 10 - RNA, 20 nt, Homo Sapiens
aaaaggaaauguacaaaaug

SEQ ID NO: 11 - RNA, 16 nt, Homo Sapiens
aacagguuacaaaaug

SEQ ID NO: 12 - RNA, 21 nt, Homo Sapiens
aaaaggcaaccuauaaacugg

SEQ ID NO: 13 - RNA, 19 nt, Homo Sapiens
aacuggcccuacaaaaagg

SEQ ID NO: 14 - RNA, 19 nt, Homo Sapiens
acaggcaacccuaaaacug

SEQ ID NO: 15 - RNA, 20 nt, Homo Sapiens
acaugcccucuacaaaaugg

SEQ ID NO: 16 - RNA, 20 nt, Homo Sapiens
acagacaccaucaaaauggg

SEQ ID NO: 17 - RNA, 19 nt, Homo Sapiens
aggcaaagugacaaaaugg

SEQ ID NO: 18 - RNA, 20 nt, Homo Sapiens
aggcaaccuagucaccaugg

SEQ ID NO: 19 - RNA, 19 nt, Homo Sapiens
aggaauucuacaaaauugg

SEQ ID NO: 20 - RNA, 21 nt, Homo Sapiens
caggacaagguacaaaauggg

SEQ ID NO: 21 - RNA, 21 nt, Homo Sapiens
gaacaggcaaacucuccaaaa

SEQ ID NO: 22 - RNA, 24 nt, Homo Sapiens
gagcgggcagccgcgacaaaaugg

SEQ ID NO: 23 - RNA, 23 nt, Homo Sapiens
gaacaaucauucucacaaaaugg

SEQ ID NO: 24 - RNA, 19 nt, Homo Sapiens
gaacaggcaaccaagcaaa

SEQ ID NO: 25 - RNA, 25 nt, Homo Sapiens
ugacacaggcaacagacugaacugg

SEQ ID NO: 26 - RNA, 17 nt, Homo Sapiens
ugaccacaaccuacaaa

SEQ ID NO: 27 - RNA, 17 nt, Homo Sapiens
ugaacaggcaaacaaaa

SEQ ID NO: 28 - RNA, 20 nt, Homo Sapiens
ugaaaggaaaauacaaaaug

SEQ ID NO: 29 - RNA, 128 nt, Homo Sapiens
uguaaauuuguuuaaguuccuuguagaugcuggauauuagaccuuugucagauggauagagugcaaaaauuuucucccauucuguagguugucgguuuacucuguugauagguucuuaaugcugugca

SEQ ID NO: 30 - RNA, 24 nt, Homo Sapiens
uauuagaccuuugucagauggaua

SEQ ID NO: 31 - RNA, 21 nt, Homo Sapiens
agaccuuuguucaaaggaaua

SEQ ID NO: 32 - RNA, 20 nt, Homo Sapiens
aggccuuugucacugaagga

SEQ ID NO: 33 - RNA, 18 nt, Homo Sapiens
auuagaccuaagagaugg

SEQ ID NO: 34 - RNA, 19 nt, Homo Sapiens
uagaccuuuggucaggugg

SEQ ID NO: 35 - RNA, 22 nt, Homo Sapiens
uacacauuugucagacgugaua

SEQ ID NO: 36 - RNA, 21 nt, Homo Sapiens
uauuaggaaacccuuugucag

SEQ ID NO: 37 - RNA, 20 nt, Homo Sapiens
uauuagcccuuugucagaug

SEQ ID NO: 38 - RNA, 23 nt, Homo Sapiens
uacuagaccuuuaucaguuagau

SEQ ID NO: 39 - RNA, 60 nt, Homo Sapiens
aaaaaagacugaauuuccuggcuuacuugcauauacagacugggauuuuuuuuuuuuuuu

SEQ ID NO: 40 - RNA, 23 nt, Homo Sapiens
gacugggauuuuuuuuuuuuuuu

SEQ ID NO: 41 - RNA, 21 nt, Homo Sapiens
aaaaaagacacuaggaauuuc

SEQ ID NO: 42 - RNA, 21 nt, Homo Sapiens
aaaaaacaccuaaauuuccug

SEQ ID NO: 43 - RNA, 20 nt, Homo Sapiens
aaaaaagacugcaacuugcu

SEQ ID NO: 44 - RNA, 19 nt, Homo Sapiens
aaaaaagacagaaaguccu

SEQ ID NO: 45 - RNA, 21 nt, Homo Sapiens
aacauaaacagaauuuccugg

SEQ ID NO: 46 - RNA, 22 nt, Homo Sapiens
aaaaaaaaaaaaauuuccuggc

SEQ ID NO: 47 - RNA, 23 nt, Homo Sapiens
aagaaaaccuguauuccuggcuu

SEQ ID NO: 48 - RNA, 22 nt, Homo Sapiens
aagaauacuugaauuuccaggc

SEQ ID NO: 49 - RNA, 23 nt, Homo Sapiens
aagaagacugaaccuuacuggcu

SEQ ID NO: 50 - RNA, 24 nt, Homo Sapiens
aaaaagacuucguccucuuggcuu

SEQ ID NO: 51 - RNA, 20 nt, Homo Sapiens
aaacagguugaauuuccagg

SEQ ID NO: 52 - RNA, 21 nt, Homo Sapiens
aaaagacugaauuuacacugg

SEQ ID NO: 53 - RNA, 20 nt, Homo Sapiens
aaagccuguccuuccuggcu

SEQ ID NO: 54 - RNA, 69 nt, Homo Sapiens
aaacaucuccaggcuuugauuuuuguaccauggaaauuguauuuaaccauacaggguuuugguauguuu

SEQ ID NO: 55 - RNA, 24 nt, Homo Sapiens
uauuuaaccauacaggguuuuggu

SEQ ID NO: 56 - RNA, 21 nt, Homo Sapiens
auauuaccauaucaggguuuu

SEQ ID NO: 57 - RNA, 17 nt, Homo Sapiens
auuucaccacaggguuu

SEQ ID NO: 58 - RNA, 19 nt, Homo Sapiens
uauuuauaaaauacagggu

SEQ ID NO: 59 - RNA, 23 nt, Homo Sapiens
uaauuaauucuauacaggguuuu

SEQ ID NO: 60 - RNA, 20 nt, Homo Sapiens
uaauaaaccauacagcauuu

SEQ ID NO: 61 - RNA, 21 nt, Homo Sapiens
uuaauucaaagagguuuuggu

SEQ ID NO: 62 - RNA, 21 nt, Homo Sapiens
uuuaauagagacaggguuuug

SEQ ID NO: 63 - RNA, 23 nt, Homo Sapiens
uuuaaccaugcagcuucuguggu

SEQ ID NO: 64 - RNA, 17 nt, Homo Sapiens
uuuaauacagggucuug

SEQ ID NO: 65 - RNA, 20 nt, Homo Sapiens
uuuuaguagacaggguuuug

SEQ ID NO: 66 - RNA, 19 nt, Homo Sapiens
uuuaaccauacguauaggu

SEQ ID NO: 67 - RNA, 61 nt, Homo Sapiens
aaagaaccucgucgugacauuucucagaagccaugacaugucccugcggcuggaggccuuu

SEQ ID NO: 68 - RNA, 23 nt, Homo Sapiens
ugucccugcggcuggaggccuuu

SEQ ID NO: 69 - RNA, 23 nt, Homo Sapiens
aagcucaggacguggacauuucu

SEQ ID NO: 70 - RNA, 22 nt, Homo Sapiens
aaucacuucagugacauuuuuc

SEQ ID NO: 71 - RNA, 18 nt, Homo Sapiens
aaccucacaugacauuuc

SEQ ID NO: 72 - RNA, 26 nt, Homo Sapiens
aagacacuuggaauagugacauuucu

SEQ ID NO: 73 - RNA, 24 nt, Homo Sapiens
aagaaccuccgucuucaaguuucu

SEQ ID NO: 74 - RNA, 20 nt, Homo Sapiens
aagaaccucaguugagaaau

SEQ ID NO: 75 - RNA, 20 nt, Homo Sapiens
aagaaacaagugugacauuu

SEQ ID NO: 76 - RNA, 18 nt, Homo Sapiens
aaguaccuggugacauuu

SEQ ID NO: 77 - RNA, 22 nt, Homo Sapiens
aagaaccuccaugaccuguguc

SEQ ID NO: 78 - RNA, 23 nt, Homo Sapiens
aauaaaaucgcauuacauuucuc

SEQ ID NO: 79 - RNA, 21 nt, Homo Sapiens
accucgucguccacaucuucu

SEQ ID NO: 80 - RNA, 19 nt, Homo Sapiens
acuuccugcugacauuucu

SEQ ID NO: 81 - RNA, 25 nt, Homo Sapiens
agaaccucgauggcaauggacauuu

SEQ ID NO: 82 - RNA, 21 nt, Homo Sapiens
aggacauugucugugacauuu

SEQ ID NO: 83 - RNA, 25 nt, Homo Sapiens
aggaccucgucgucguccucuucuc

SEQ ID NO: 84 - RNA, 22 nt, Homo Sapiens
cccugcggcaggucgaggcauu

SEQ ID NO: 85 - RNA, 19 nt, Homo Sapiens
ccugugacuggaggccauu

SEQ ID NO: 86 - RNA, 20 nt, Homo Sapiens
gaacagagccaugacauuuc

SEQ ID NO: 87 - RNA, 17 nt, Homo Sapiens
gucccaggcuggaggcc

SEQ ID NO: 88 - RNA, 18 nt, Homo Sapiens
gucccugcggcggucgcc

SEQ ID NO: 89 - RNA, 20 nt, Homo Sapiens
ucccugcggcacaggaggcc

SEQ ID NO: 90 - RNA, 19 nt, Homo Sapiens
ucccaggagcuggaggccu

SEQ ID NO: 91 - RNA, 20 nt, Homo Sapiens
ugucccugcagccuggcagg

SEQ ID NO: 92 - RNA, 20 nt, Homo Sapiens
ugucccugcgcucugggggc

SEQ ID NO: 93 - RNA, 18 nt, Homo Sapiens
ugucccugcggugugggc

SEQ ID NO: 94 - RNA, 26 nt, Homo Sapiens
uguccccacggcuggaggcacgcuuu

SEQ ID NO: 95 - RNA, 17 nt, Homo Sapiens
ugucccugcugggggcc

SEQ ID NO: 96 - RNA, 22 nt, Homo Sapiens
ugccccucccucaggaggccuu

SEQ ID NO: 97 - RNA, 81 nt, Homo Sapiens
aaaguccuacgugacugauuuuaaacauugugauaaaauuaauuuucaguauaauaguugaauguguuaagauaggauuuu

SEQ ID NO: 98 - RNA, 24 nt, Homo Sapiens
uaauaguugaauguguuaagauag

SEQ ID NO: 99 - RNA, 24 nt, Homo Sapiens
aauaguugaacaacuuuuuaagau

SEQ ID NO: 100 - RNA, 27 nt, Homo Sapiens
aauaguugagcacugagguuaacauag

SEQ ID NO: 101 - RNA, 21 nt, Homo Sapiens
aauaguugaugucuuuaagau

SEQ ID NO: 102 - RNA, 21 nt, Homo Sapiens
aacaguuucaguguuaagaua

SEQ ID NO: 103 - RNA, 22 nt, Homo Sapiens
auaguugaagguguacuuaaga

SEQ ID NO: 104 - RNA, 24 nt, Homo Sapiens
auagcagaauguguucaaaaguag

SEQ ID NO: 105 - RNA, 18 nt, Homo Sapiens
augguuaaauguuaagau

SEQ ID NO: 106 - RNA, 23 nt, Homo Sapiens
guugaauguguuggacaugauag

SEQ ID NO: 107 - RNA, 25 nt, Homo Sapiens
uaacuaguugaauaugauuuaaaua

SEQ ID NO: 108 - RNA, 25 nt, Homo Sapiens
uaauaguuggugaaugucuguaaag

SEQ ID NO: 109 - RNA, 28 nt, Homo Sapiens
uaauaauucaaugaauguguuacacaua

SEQ ID NO: 110 - RNA, 25 nt, Homo Sapiens
uaauaguaggaaugcauguuaagau

SEQ ID NO: 111 - RNA, 21 nt, Homo Sapiens
uaauaguuucaauguguuaag

SEQ ID NO: 112 - RNA, 24 nt, Homo Sapiens
uaauaguugagcacaguuuuaaga

SEQ ID NO: 113 - RNA, 18 nt, Homo Sapiens
uaaaguugaauguuguaa

SEQ ID NO: 114 - RNA, 18 nt, Homo Sapiens
uaauaggaaguguuaaga

SEQ ID NO: 115 - RNA, 21 nt, Homo Sapiens
uaauaguugaauuuauuuaga

SEQ ID NO: 116 - RNA, 18 nt, Homo Sapiens
uacuaguugaauuaagau

SEQ ID NO: 117 - RNA, 20 nt, Homo Sapiens
uaguugaauguugaaugaua

SEQ ID NO: 118 - RNA, 19 nt, Homo Sapiens
uugaauucuuguuaagaua

SEQ ID NO: 119 - RNA, 63 nt, Homo Sapiens
aaauaugcgcgagaaccgccgcggugugacaaaaaccgcgccgccggggcucuuauuauauuu

SEQ ID NO: 120 - RNA, 24 nt, Homo Sapiens
uaugcgcgagaaccgccgcggugu

SEQ ID NO: 121 - RNA, 19 nt, Homo Sapiens
auggggagaaccgcugggg

SEQ ID NO: 122 - RNA, 18 nt, Homo Sapiens
cgcugaggccgccgcggu

SEQ ID NO: 123 - RNA, 20 nt, Homo Sapiens
gcgccgagccgcgccgcggu

SEQ ID NO: 124 - RNA, 20 nt, Homo Sapiens
gcgccgaggccgccgcggug

SEQ ID NO: 125 - RNA, 21 nt, Homo Sapiens
gcgcaagacaggccgccgcgg

SEQ ID NO: 126 - RNA, 19 nt, Homo Sapiens
gcgcgagaggccgccgcgg

SEQ ID NO: 127 - RNA, 18 nt, Homo Sapiens
gcccgagcagccgcggug

SEQ ID NO: 128 - RNA, 19 nt, Homo Sapiens
gcgcgagaaggccugggug

SEQ ID NO: 129 - RNA, 20 nt, Homo Sapiens
gcgcgcgcuaggccgcggug

SEQ ID NO: 130 - RNA, 21 nt, Homo Sapiens
ugcugggagagcgccgcggug

SEQ ID NO: 131 - RNA, 19 nt, Homo Sapiens
ugcgacccgaaccgccgcg

SEQ ID NO: 132 - RNA, 20 nt, Homo Sapiens
ugccggagaaccgcggccgu

SEQ ID NO: 133 - RNA, 20 nt, Homo Sapiens
ugggcggaggcgccgcggug

SEQ ID NO: 134 - RNA, 62 nt, Homo Sapiens
aaaucacauuucuuuuuaucauguaaacuuguaccaaagacuuaugaauagauuuaugaauu

SEQ ID NO: 135 - RNA, 24 nt, Homo Sapiens
ucacauuucuuuuuaucauguaaa

SEQ ID NO: 136 - RNA, 22 nt, Homo Sapiens
acauuucuuucucuacauuaaa

SEQ ID NO: 137 - RNA, 21 nt, Homo Sapiens
auuucuuuuauaucagugcaa

SEQ ID NO: 138 - RNA, 19 nt, Homo Sapiens
augucuuuuaucauauaaa

SEQ ID NO: 139 - RNA, 24 nt, Homo Sapiens
cacauuuuucuuuuuaccagaaaa

SEQ ID NO: 140 - RNA, 21 nt, Homo Sapiens
cacauuucuuauuaauaaugu

SEQ ID NO: 141 - RNA, 23 nt, Homo Sapiens
caccuuucuuuuuuugacaugua

SEQ ID NO: 142 - RNA, 24 nt, Homo Sapiens
cacuuuucuuuuuuucaagguaaa

SEQ ID NO: 143 - RNA, 25 nt, Homo Sapiens
cacauuucuuuguuucagguguaaa

SEQ ID NO: 144 - RNA, 20 nt, Homo Sapiens
cacauuucuguuuucaggua

SEQ ID NO: 145 - RNA, 19 nt, Homo Sapiens
cauuucuuugucucuugua

SEQ ID NO: 146 - RNA, 21 nt, Homo Sapiens
cauugcauaguaucauguaaa

SEQ ID NO: 147 - RNA, 27 nt, Homo Sapiens
ucacauuuucuuuuuauuuucauuuaa

SEQ ID NO: 148 - RNA, 24 nt, Homo Sapiens
ucacauuucagauuucuaucaggu

SEQ ID NO: 149 - RNA, 22 nt, Homo Sapiens
ucacauuucuauuuuuguaugu

SEQ ID NO: 150 - RNA, 23 nt, Homo Sapiens
ucccauucuuuuuauuugcaugu

SEQ ID NO: 151 - RNA, 18 nt, Homo Sapiens
ucacauuucucuguacau

SEQ ID NO: 152 - RNA, 19 nt, Homo Sapiens
ucacauuucuuuggagcau

SEQ ID NO: 153 - RNA, 20 nt, Homo Sapiens
ucccuuuucuuuuaucaugu

SEQ ID NO: 154 - RNA, 21 nt, Homo Sapiens
ucacauuucuuuauauuugua

SEQ ID NO: 155 - RNA, 22 nt, Homo Sapiens
ucacuauccuuuuuaucuugua

SEQ ID NO: 156 - RNA, 23 nt, Homo Sapiens
ucacuuucuuuuuaacaggcaaa

SEQ ID NO: 157 - RNA, 24 nt, Homo Sapiens
ucacauuucuugugaccauuuaaa

SEQ ID NO: 158 - RNA, 24 nt, Homo Sapiens
ucauguuucuuuuucuccuuuaaa

SEQ ID NO: 159 - RNA, 19 nt, Homo Sapiens
uuucuuuuuaaucaucuaa

SEQ ID NO: 160 - RNA, 110 nt, Homo Sapiens
aagaaauaguuuuaaguaacuuuuuauagcaagaugauacaaugguaugaguguaaucuaaacuuccuuguuguauuaccuuguaugcuguuacuuuuauuuuauuccuu

SEQ ID NO: 161 - RNA, 24 nt, Homo Sapiens
uagcaagaugauacaaugguauga

SEQ ID NO: 162 - RNA, 16 nt, Homo Sapiens
aagaugauagguauga

SEQ ID NO: 163 - RNA, 21 nt, Homo Sapiens
agcauugaugauacaauauga

SEQ ID NO: 164 - RNA, 19 nt, Homo Sapiens
aggaagaugauaccaaagg

SEQ ID NO: 165 - RNA, 18 nt, Homo Sapiens
agcaagaugucaugguau

SEQ ID NO: 166 - RNA, 20 nt, Homo Sapiens
caagaugaugacaguauaug

SEQ ID NO: 167 - RNA, 17 nt, Homo Sapiens
caggaagaaaugguaug

SEQ ID NO: 168 - RNA, 21 nt, Homo Sapiens
gcaagaugauagagaagguau

SEQ ID NO: 169 - RNA, 18 nt, Homo Sapiens
gcaagaugagagaaguau

SEQ ID NO: 170 - RNA, 23 nt, Homo Sapiens
uaguaacaauaaucacaauggua

SEQ ID NO: 171 - RNA, 22 nt, Homo Sapiens
uagcaaaaaagaucaaugguau

SEQ ID NO: 172 - RNA, 24 nt, Homo Sapiens
uagcaagaugugugcaaaguucug

SEQ ID NO: 173 - RNA, 23 nt, Homo Sapiens
uagcacaugauacaaucugggua

SEQ ID NO: 174 - RNA, 22 nt, Homo Sapiens
uaccaagaugaugggauggaau

SEQ ID NO: 175 - RNA, 22 nt, Homo Sapiens
uauccagaugauacaugagaug

SEQ ID NO: 176 - RNA, 24 nt, Homo Sapiens
uagccuaaugugccaaugguauga

SEQ ID NO: 177 - RNA, 69 nt, Homo Sapiens
aagaaggugaugccgaagcugaggucggaaauuacgaagaucagcuaucaaacuuggaaaucaugucuu

SEQ ID NO: 178 - RNA, 24 nt, Homo Sapiens
ucagcuaucaaacuuggaaaucau

SEQ ID NO: 179 - RNA, 23 nt, Homo Sapiens
agcucaaaaacucuggaaaucau

SEQ ID NO: 180 - RNA, 20 nt, Homo Sapiens
cagcuaucacucaacuagga

SEQ ID NO: 181 - RNA, 23 nt, Homo Sapiens
cagcaaccaacuuggaacaccau

SEQ ID NO: 182 - RNA, 19 nt, Homo Sapiens
cagcuaucagucaugcaaa

SEQ ID NO: 183 - RNA, 16 nt, Homo Sapiens
cuaucaaacuaaauca

SEQ ID NO: 184 - RNA, 16 nt, Homo Sapiens
gcuaucaaacaaauca

SEQ ID NO: 185 - RNA, 19 nt, Homo Sapiens
uaucaaacuuuaagaaauc

SEQ ID NO: 186 - RNA, 19 nt, Homo Sapiens
uauuaagguuggaaaucau

SEQ ID NO: 187 - RNA, 18 nt, Homo Sapiens
ucagcuaucaaaaaucau

SEQ ID NO: 188 - RNA, 76 nt, Homo Sapiens
aagaugcuacccagcaucuuuaaaccagcuuggugcggauagucugacuaguuuaaggagacuggcgaagcgucuu

SEQ ID NO: 189 - RNA, 24 nt, Homo Sapiens
gacuaguuuaaggagacuggcgaa

SEQ ID NO: 190 - RNA, 23 nt, Homo Sapiens
accucauccacuuuaaccagcuu

SEQ ID NO: 191 - RNA, 23 nt, Homo Sapiens
acccagcaucuuacaaaaccagc

SEQ ID NO: 192 - RNA, 21 nt, Homo Sapiens
acccggcaucuuuacaaaacc

SEQ ID NO: 193 - RNA, 23 nt, Homo Sapiens
acccagucucauucaaaccagcu

SEQ ID NO: 194 - RNA, 20 nt, Homo Sapiens
acuagcucuaaggagacugg

SEQ ID NO: 195 - RNA, 21 nt, Homo Sapiens
ccaacaaucuuuaaacugcuu

SEQ ID NO: 196 - RNA, 24 nt, Homo Sapiens
cccagggcuuguucaaaccagcuu

SEQ ID NO: 197 - RNA, 20 nt, Homo Sapiens
cccagcaucucuucucccag

SEQ ID NO: 198 - RNA, 19 nt, Homo Sapiens
cccagcaucuagacuccag

SEQ ID NO: 199 - RNA, 20 nt, Homo Sapiens
gacuaguuuuaguacacugg

SEQ ID NO: 200 - RNA, 22 nt, Homo Sapiens
uaccaacaucaucuuuaaaaca

SEQ ID NO: 201 - RNA, 22 nt, Homo Sapiens
uaccccuggcaucuuuaaaaca

SEQ ID NO: 202 - RNA, 25 nt, Homo Sapiens
uacccagcacuccacaaaggagcuu

SEQ ID NO: 203 - RNA, 27 nt, Homo Sapiens
uacacagcaucuuuuaaaguccaucuu

SEQ ID NO: 204 - RNA, 22 nt, Homo Sapiens
uacccagcaucaucauaaaaca

SEQ ID NO: 205 - RNA, 25 nt, Homo Sapiens
uacccagcaccuucaaugugaccag

SEQ ID NO: 206 - RNA, 24 nt, Homo Sapiens
uacccaucuuuaaacaccaggcuu

SEQ ID NO: 207 - RNA, 23 nt, Homo Sapiens
uacccagcacuguaagcacgagc

SEQ ID NO: 208 - RNA, 64 nt, Homo Sapiens
aagauguagcggguuuucuggugguggauccgaagaugggccacagagauuccacuuuccucuu

SEQ ID NO: 209 - RNA, 24 nt, Homo Sapiens
uagcggguuuucuggugguggauc

SEQ ID NO: 210 - RNA, 22 nt, Homo Sapiens
gcugcuuucucuuugguggauc

SEQ ID NO: 211 - RNA, 21 nt, Homo Sapiens
gcagguuuucugggucgucga

SEQ ID NO: 212 - RNA, 20 nt, Homo Sapiens
gggucguucuggugguagau

SEQ ID NO: 213 - RNA, 18 nt, Homo Sapiens
ggguuuucuguugugaau

SEQ ID NO: 214 - RNA, 69 nt, Homo Sapiens
aaggcgggguuucaccauguuggccaggcuggucucaaacuccugaccucaaguggauaugccugccuu

SEQ ID NO: 215 - RNA, 24 nt, Homo Sapiens
ugaccucaaguggauaugccugcc

SEQ ID NO: 216 - RNA, 21 nt, Homo Sapiens
accucaagugauccaccugcc

SEQ ID NO: 217 - RNA, 22 nt, Homo Sapiens
gaccucaagugaucugccugcc

SEQ ID NO: 218 - RNA, 21 nt, Homo Sapiens
ugaccucaaggcugcaaaugc

SEQ ID NO: 219 - RNA, 22 nt, Homo Sapiens
ugaccucaagugaucuguccug

SEQ ID NO: 220 - RNA, 19 nt, Homo Sapiens
ugaccucaagugaucugcc

SEQ ID NO: 221 - RNA, 19 nt, Homo Sapiens
uggccucaagugaucugcc

SEQ ID NO: 222 - RNA, 21 nt, Homo Sapiens
ugaccucaagugaucugcuug

SEQ ID NO: 223 - RNA, 23 nt, Homo Sapiens
ugaccucaagagguaauucaugc

SEQ ID NO: 224 - RNA, 22 nt, Homo Sapiens
ugaccucaagugaucugcuugc

SEQ ID NO: 225 - RNA, 23 nt, Homo Sapiens
ugaccucaaaugaucugcccgcc

SEQ ID NO: 226 - RNA, 23 nt, Homo Sapiens
ugaccucaagucaucugcccgcc

SEQ ID NO: 227 - RNA, 23 nt, Homo Sapiens
ugaccucaagugauccacccgcc

SEQ ID NO: 228 - RNA, 23 nt, Homo Sapiens
ugaccucaagugauccaccugcc

SEQ ID NO: 229 - RNA, 23 nt, Homo Sapiens
ugaccucaagugauccgcccgcc

SEQ ID NO: 230 - RNA, 23 nt, Homo Sapiens
ugaccucaagugauccuccugcc

SEQ ID NO: 231 - RNA, 23 nt, Homo Sapiens
ugaccucaagugaucugccugcc

SEQ ID NO: 232 - RNA, 23 nt, Homo Sapiens
uggccucaagugauccaccugcc

SEQ ID NO: 233 - RNA, 23 nt, Homo Sapiens
uggccucaagugauccuccugcc

SEQ ID NO: 234 - RNA, 24 nt, Homo Sapiens
uggccucaaguugauaugccugcc

SEQ ID NO: 235 - RNA, 68 nt, Homo Sapiens
aaggggaucugaaaaccagagcguccccggcgcucccuucugugccgcccgcuuaggcagguucccuu

SEQ ID NO: 236 - RNA, 24 nt, Homo Sapiens
ucugaaaaccagagcguccccggc

SEQ ID NO: 237 - RNA, 21 nt, Homo Sapiens
aaaaccagaggcuucacccgg

SEQ ID NO: 238 - RNA, 19 nt, Homo Sapiens
aaaccagagggcccaaggc

SEQ ID NO: 239 - RNA, 20 nt, Homo Sapiens
gaaaaccaggcggccucccc

SEQ ID NO: 240 - RNA, 16 nt, Homo Sapiens
gaaacccgcguccccg

SEQ ID NO: 241 - RNA, 19 nt, Homo Sapiens
ucugaaaaccaccagccuc

SEQ ID NO: 242 - RNA, 23 nt, Homo Sapiens
ucugaaaacacagaauccccugc

SEQ ID NO: 243 - RNA, 21 nt, Homo Sapiens
ucuggcagccagguccccggc

SEQ ID NO: 244 - RNA, 26 nt, Homo Sapiens
ugaaaaccagacgaggcguccgccgg

SEQ ID NO: 245 - RNA, 86 nt, Homo Sapiens
aagguguccaggccacagucucaagggcuuucuagcagcuuggggcuccugaaagucuggcugacucugcuucucucggacaccuu

SEQ ID NO: 246 - RNA, 24 nt, Homo Sapiens
ugaaagucuggcugacucugcuuc

SEQ ID NO: 247 - RNA, 20 nt, Homo Sapiens
aaagaccucaggcugacucu

SEQ ID NO: 248 - RNA, 22 nt, Homo Sapiens
aaagucuggccuuuccucuucu

SEQ ID NO: 249 - RNA, 20 nt, Homo Sapiens
aaagucugggaucugugcuu

SEQ ID NO: 250 - RNA, 19 nt, Homo Sapiens
aaagccacccugacucugc

SEQ ID NO: 251 - RNA, 20 nt, Homo Sapiens
aaguacuagcucucugcuuc

SEQ ID NO: 252 - RNA, 22 nt, Homo Sapiens
agucuggcugguucuagacuuc

SEQ ID NO: 253 - RNA, 23 nt, Homo Sapiens
gaaagcuucaugaucucugcuuc

SEQ ID NO: 254 - RNA, 18 nt, Homo Sapiens
gugugagugcucugcuuc

SEQ ID NO: 255 - RNA, 20 nt, Homo Sapiens
ugacagcuccuggcugacuc

SEQ ID NO: 256 - RNA, 23 nt, Homo Sapiens
ugaaagucugaagucugacuaug

SEQ ID NO: 257 - RNA, 19 nt, Homo Sapiens
ugaaagucugaggugaguc

SEQ ID NO: 258 - RNA, 26 nt, Homo Sapiens
ugaaauucaagucuuaucucugcuuc

SEQ ID NO: 259 - RNA, 73 nt, Homo Sapiens
aauaaaaagcuaaccugguucaaaaugcugauuaaguuucuacaagcaaacacaaaacaguguuuuuuuuauu

SEQ ID NO: 260 - RNA, 24 nt, Homo Sapiens
uaaaaagcuaaccugguucaaaau

SEQ ID NO: 261 - RNA, 21 nt, Homo Sapiens
aaaaagcuagcaucuguauca

SEQ ID NO: 262 - RNA, 19 nt, Homo Sapiens
aaagcuaacaaggaaaaau

SEQ ID NO: 263 - RNA, 61 nt, Homo Sapiens
aauaaaauuucucaaacuauaucaauaucuaaagugcauauauuuuuuaagaaagauuauu

SEQ ID NO: 264 - RNA, 24 nt, Homo Sapiens
uaaaauuucucaaacuauaucaau

SEQ ID NO: 265 - RNA, 25 nt, Homo Sapiens
aaaauuucuauucaaacuuuuuaaa

SEQ ID NO: 266 - RNA, 23 nt, Homo Sapiens
aaaaugucaucacuaacuauauc

SEQ ID NO: 267 - RNA, 28 nt, Homo Sapiens
aaaauuucuccaauaaccuguaugcaau

SEQ ID NO: 268 - RNA, 26 nt, Homo Sapiens
aaaauuucucaacaauuuauaacaau

SEQ ID NO: 269 - RNA, 24 nt, Homo Sapiens
aaauuuucucaaauuagcuuucaa

SEQ ID NO: 270 - RNA, 19 nt, Homo Sapiens
aaaauaguucaaacuauau

SEQ ID NO: 271 - RNA, 18 nt, Homo Sapiens
aaaauuaccaaacuauau

SEQ ID NO: 272 - RNA, 19 nt, Homo Sapiens
aaaguuucucaaacucuau

SEQ ID NO: 273 - RNA, 21 nt, Homo Sapiens
aaaauuucuaaacacucucaa

SEQ ID NO: 274 - RNA, 19 nt, Homo Sapiens
aaauuuccucaaacuacau

SEQ ID NO: 275 - RNA, 20 nt, Homo Sapiens
aaaagucucaaacuuuacca

SEQ ID NO: 276 - RNA, 24 nt, Homo Sapiens
aauuuguugcaaacacuauaucaa

SEQ ID NO: 277 - RNA, 19 nt, Homo Sapiens
uaaaaguuucucucaaacu

SEQ ID NO: 278 - RNA, 21 nt, Homo Sapiens
uacaaugguucucaaacuuua

SEQ ID NO: 279 - RNA, 25 nt, Homo Sapiens
uaaaauuucaucauacaauuucuau

SEQ ID NO: 280 - RNA, 24 nt, Homo Sapiens
uauaaauucucaauaacuauauca

SEQ ID NO: 281 - RNA, 19 nt, Homo Sapiens
uauaauuucccaaacuaua

SEQ ID NO: 282 - RNA, 21 nt, Homo Sapiens
uaaacuuucucaaacuggauc

SEQ ID NO: 283 - RNA, 73 nt, Homo Sapiens
aaucccauuuugggguuuuccauccggaauuuuuguuuuuaauaaggguucaguuucuuuuuccccagggauu

SEQ ID NO: 284 - RNA, 24 nt, Homo Sapiens
uaaggguucaguuucuuuuucccc

SEQ ID NO: 285 - RNA, 21 nt, Homo Sapiens
aagguguugugcuuucuuuuu

SEQ ID NO: 286 - RNA, 26 nt, Homo Sapiens
aagggagcagguuuuucuuuuuuccc

SEQ ID NO: 287 - RNA, 17 nt, Homo Sapiens
aaagguaguuucuuuuu

SEQ ID NO: 288 - RNA, 20 nt, Homo Sapiens
aaggcuuuuuuuuuuucccc

SEQ ID NO: 289 - RNA, 25 nt, Homo Sapiens
agguucucaguuucuucuauuuccc

SEQ ID NO: 290 - RNA, 23 nt, Homo Sapiens
aggguucaggugucuuaguuucc

SEQ ID NO: 291 - RNA, 23 nt, Homo Sapiens
aggguucagacuuauguuuuccc

SEQ ID NO: 292 - RNA, 20 nt, Homo Sapiens
ggguucggaauuucuuuuuc

SEQ ID NO: 293 - RNA, 20 nt, Homo Sapiens
ggguucaguauaauuuuucc

SEQ ID NO: 294 - RNA, 19 nt, Homo Sapiens
ggguuauuuuuuuuucccc

SEQ ID NO: 295 - RNA, 20 nt, Homo Sapiens
ggaucuguugcucuuuuucc

SEQ ID NO: 296 - RNA, 19 nt, Homo Sapiens
guucacauuuuuuuucccc

SEQ ID NO: 297 - RNA, 21 nt, Homo Sapiens
uagggguuaugcuuucuuuuu

SEQ ID NO: 298 - RNA, 23 nt, Homo Sapiens
uaaggguucaguuuacacuucuu

SEQ ID NO: 299 - RNA, 19 nt, Homo Sapiens
uucauguuucuuuuucucc

SEQ ID NO: 300 - RNA, 61 nt, Homo Sapiens
aaugacaccguugauugagcuugucagcagagcugaaagagacagucgacggaugugcauu

SEQ ID NO: 301 - RNA, 24 nt, Homo Sapiens
ugacaccguugauugagcuuguca

SEQ ID NO: 302 - RNA, 24 nt, Homo Sapiens
acacucuuugaaacguugagcuug

SEQ ID NO: 303 - RNA, 18 nt, Homo Sapiens
acaccuugauugagccug

SEQ ID NO: 304 - RNA, 22 nt, Homo Sapiens
gacacuguacaaaugagcuugu

SEQ ID NO: 305 - RNA, 20 nt, Homo Sapiens
gacccguugauugcuucuca

SEQ ID NO: 306 - RNA, 19 nt, Homo Sapiens
ugucacuugaauugagcuu

SEQ ID NO: 307 - RNA, 22 nt, Homo Sapiens
ugacaccguuccuaugcccuug

SEQ ID NO: 308 - RNA, 22 nt, Homo Sapiens
uggcacuugauugagaaaguca

SEQ ID NO: 309 - RNA, 60 nt, Homo Sapiens
aaugaguuucuuacucgggagcuggcugaagauggcuacucuggaguugaggugcgaguu

SEQ ID NO: 310 - RNA, 24 nt, Homo Sapiens
ugaguuucuuacucgggagcuggc

SEQ ID NO: 311 - RNA, 21 nt, Homo Sapiens
acuuugcaaggcugaggugcg

SEQ ID NO: 312 - RNA, 23 nt, Homo Sapiens
agucugcguccuggggagcuggc

SEQ ID NO: 313 - RNA, 24 nt, Homo Sapiens
aguuucuuagaacuggggagcugg

SEQ ID NO: 314 - RNA, 20 nt, Homo Sapiens
cuacucuggcguggaaaugc

SEQ ID NO: 315 - RNA, 17 nt, Homo Sapiens
cuccucaguugaggugc

SEQ ID NO: 316 - RNA, 20 nt, Homo Sapiens
gaguuucuugccggggcagg

SEQ ID NO: 317 - RNA, 19 nt, Homo Sapiens
gcuaccucuggaguggugg

SEQ ID NO: 318 - RNA, 25 nt, Homo Sapiens
gcuaucuaaaggagugugaggugcg

SEQ ID NO: 319 - RNA, 19 nt, Homo Sapiens
gcuacucuggaggcugagg

SEQ ID NO: 320 - RNA, 20 nt, Homo Sapiens
gcuacucaggaaguugaggu

SEQ ID NO: 321 - RNA, 22 nt, Homo Sapiens
gccacucuggaggaaagaggug

SEQ ID NO: 322 - RNA, 21 nt, Homo Sapiens
gcuacuccgaagguugaggug

SEQ ID NO: 323 - RNA, 17 nt, Homo Sapiens
gcuacuggaguuggggu

SEQ ID NO: 324 - RNA, 22 nt, Homo Sapiens
gcugcugggaguugagguagcg

SEQ ID NO: 325 - RNA, 19 nt, Homo Sapiens
ggcacacugggaguugagg

SEQ ID NO: 326 - RNA, 18 nt, Homo Sapiens
ggcuacucugagaugagg

SEQ ID NO: 327 - RNA, 20 nt, Homo Sapiens
ggcuacucugggauucaggu

SEQ ID NO: 328 - RNA, 20 nt, Homo Sapiens
guuucuuacucagacagagc

SEQ ID NO: 329 - RNA, 19 nt, Homo Sapiens
guuucuuacaggugcuggc

SEQ ID NO: 330 - RNA, 22 nt, Homo Sapiens
ugaggcuuucuuggggagcugg

SEQ ID NO: 331 - RNA, 24 nt, Homo Sapiens
ugaguuucuuguuaguuggaguug

SEQ ID NO: 332 - RNA, 20 nt, Homo Sapiens
ugagucgaugacucgggagc

SEQ ID NO: 333 - RNA, 24 nt, Homo Sapiens
uggacacugacagggguugaggug

SEQ ID NO: 334 - RNA, 23 nt, Homo Sapiens
uggcgccucuggaguugugugug

SEQ ID NO: 335 - RNA, 18 nt, Homo Sapiens
uggcuauuggaguugagg

SEQ ID NO: 336 - RNA, 22 nt, Homo Sapiens
uggcagucagcuguugaggugc

SEQ ID NO: 337 - RNA, 62 nt, Homo Sapiens
aauucucaaaggugcuagaacaaaucguccacuucuacaguguucucguauccaacagaguu

SEQ ID NO: 338 - RNA, 24 nt, Homo Sapiens
ucaaaggugcuagaacaaaucguc

SEQ ID NO: 339 - RNA, 20 nt, Homo Sapiens
aaaggugucacagaacaaau

SEQ ID NO: 340 - RNA, 19 nt, Homo Sapiens
aaaggugcugaacagaauc

SEQ ID NO: 341 - RNA, 19 nt, Homo Sapiens
aaggcacugagaacaaauc

SEQ ID NO: 342 - RNA, 18 nt, Homo Sapiens
aaggugcuaagaaaaauc

SEQ ID NO: 343 - RNA, 22 nt, Homo Sapiens
acaguguucuuccauuuccuac

SEQ ID NO: 344 - RNA, 25 nt, Homo Sapiens
acaguguucccaaggaucucagcag

SEQ ID NO: 345 - RNA, 23 nt, Homo Sapiens
acacuguuuccagcuauccaaca

SEQ ID NO: 346 - RNA, 20 nt, Homo Sapiens
acaguguucuuuucaagaga

SEQ ID NO: 347 - RNA, 21 nt, Homo Sapiens
agugauuaucucuccaacaga

SEQ ID NO: 348 - RNA, 19 nt, Homo Sapiens
agaguucucguagcauaca

SEQ ID NO: 349 - RNA, 20 nt, Homo Sapiens
aguguucuccucuccaucag

SEQ ID NO: 350 - RNA, 17 nt, Homo Sapiens
caaaugaggaacaaauc

SEQ ID NO: 351 - RNA, 22 nt, Homo Sapiens
cacuguauccuguauccaacag

SEQ ID NO: 352 - RNA, 20 nt, Homo Sapiens
caguguucuugcagauccaa

SEQ ID NO: 353 - RNA, 23 nt, Homo Sapiens
caguuucuggugcauccaacaga

SEQ ID NO: 354 - RNA, 16 nt, Homo Sapiens
caguguucuauacaac

SEQ ID NO: 355 - RNA, 17 nt, Homo Sapiens
caguguucucccaagag

SEQ ID NO: 356 - RNA, 21 nt, Homo Sapiens
guguauugguaauccaacaga

SEQ ID NO: 357 - RNA, 28 nt, Homo Sapiens
uacaguguuccuucagucugcacaaaga

SEQ ID NO: 358 - RNA, 24 nt, Homo Sapiens
uacaggguucucguauccaacaga

SEQ ID NO: 359 - RNA, 18 nt, Homo Sapiens
ucaaagguguagaaaaau

SEQ ID NO: 360 - RNA, 20 nt, Homo Sapiens
ucaaaggugcaugaaacaau

SEQ ID NO: 361 - RNA, 20 nt, Homo Sapiens
uccaaggggccagaacaaau

SEQ ID NO: 362 - RNA, 20 nt, Homo Sapiens
ucaaaggugugguagaaauc

SEQ ID NO: 363 - RNA, 24 nt, Homo Sapiens
ucaaaggggcuaaaacaaaucguc

SEQ ID NO: 364 - RNA, 24 nt, Homo Sapiens
uccaaggugcuacaauagcugguc

SEQ ID NO: 365 - RNA, 76 nt, Homo Sapiens
acaaggggaugacuggugggucucucuuggcccgugguggcgguccggggggggcuucuuccuuacgucccucugu

SEQ ID NO: 366 - RNA, 24 nt, Homo Sapiens
ugacuggugggucucucuuggccc

SEQ ID NO: 367 - RNA, 25 nt, Homo Sapiens
acugcuguggcugcuacucuuggcc

SEQ ID NO: 368 - RNA, 21 nt, Homo Sapiens
acugguggggucgucucucgg

SEQ ID NO: 369 - RNA, 19 nt, Homo Sapiens
acagguggcuucucucuug

SEQ ID NO: 370 - RNA, 23 nt, Homo Sapiens
acugguggggcugggacucuugg

SEQ ID NO: 371 - RNA, 23 nt, Homo Sapiens
acuggugggucacaucucgggcc

SEQ ID NO: 372 - RNA, 23 nt, Homo Sapiens
cuggcuggggcucucucucuugg

SEQ ID NO: 373 - RNA, 20 nt, Homo Sapiens
cuguugggucucuggucuug

SEQ ID NO: 374 - RNA, 19 nt, Homo Sapiens
cuggaaugccucucuuggc

SEQ ID NO: 375 - RNA, 19 nt, Homo Sapiens
cugcuggcuccucuuggcc

SEQ ID NO: 376 - RNA, 19 nt, Homo Sapiens
gguggggccacucuuggcc

SEQ ID NO: 377 - RNA, 22 nt, Homo Sapiens
gguuggucucaaacucuuggcc

SEQ ID NO: 378 - RNA, 16 nt, Homo Sapiens
gguggguucuuggccc

SEQ ID NO: 379 - RNA, 21 nt, Homo Sapiens
ugaucuguugauucucucuug

SEQ ID NO: 380 - RNA, 24 nt, Homo Sapiens
ugccugugcugucucucuugggcc

SEQ ID NO: 381 - RNA, 24 nt, Homo Sapiens
ugacugguacuauaaucuuggccc

SEQ ID NO: 382 - RNA, 22 nt, Homo Sapiens
ugacuggugcuucuuuccuugc

SEQ ID NO: 383 - RNA, 21 nt, Homo Sapiens
ugucugugggguucucuuggc

SEQ ID NO: 384 - RNA, 22 nt, Homo Sapiens
ugacugggacccucucuuggcc

SEQ ID NO: 385 - RNA, 21 nt, Homo Sapiens
ugguugggucucuucugcccc

SEQ ID NO: 386 - RNA, 22 nt, Homo Sapiens
uggugggucccacuccuggccc

SEQ ID NO: 387 - RNA, 64 nt, Homo Sapiens
acaggcaugagccacugcgcccagccuggaaguuaauuuuuaugguuguguauguguugcuugu

SEQ ID NO: 388 - RNA, 24 nt, Homo Sapiens
caugagccacugcgcccagccugg

SEQ ID NO: 389 - RNA, 21 nt, Homo Sapiens
augagccacugagcccugccu

SEQ ID NO: 390 - RNA, 23 nt, Homo Sapiens
caugaggccacugcgcccagccu

SEQ ID NO: 391 - RNA, 20 nt, Homo Sapiens
caugagccacugugcccagc

SEQ ID NO: 392 - RNA, 21 nt, Homo Sapiens
caugagccaccgugcccggcc

SEQ ID NO: 393 - RNA, 21 nt, Homo Sapiens
caugagccacugcacccagcc

SEQ ID NO: 394 - RNA, 20 nt, Homo Sapiens
caugagccacugcgccagcc

SEQ ID NO: 395 - RNA, 21 nt, Homo Sapiens
caugagccacugcgcccagcc

SEQ ID NO: 396 - RNA, 21 nt, Homo Sapiens
caugagccacugcgcccggcc

SEQ ID NO: 397 - RNA, 22 nt, Homo Sapiens
caugagccaccgcgcccggccu

SEQ ID NO: 398 - RNA, 22 nt, Homo Sapiens
caugagccacugcacccggccu

SEQ ID NO: 399 - RNA, 23 nt, Homo Sapiens
caugagccacugugcccggccug

SEQ ID NO: 400 - RNA, 23 nt, Homo Sapiens
caugagccacugugcucggccug

SEQ ID NO: 401 - RNA, 24 nt, Homo Sapiens
caugagccaccgcacccggccugg

SEQ ID NO: 402 - RNA, 19 nt, Homo Sapiens
ccacugcacuccagccugg

SEQ ID NO: 403 - RNA, 19 nt, Homo Sapiens
ccucugcacuccagccugg

SEQ ID NO: 404 - RNA, 20 nt, Homo Sapiens
gccaaugcacuccagccugg

SEQ ID NO: 405 - RNA, 20 nt, Homo Sapiens
gccacggcacuccagccugg

SEQ ID NO: 406 - RNA, 20 nt, Homo Sapiens
gccacuacacuccagccugg

SEQ ID NO: 407 - RNA, 20 nt, Homo Sapiens
gccacugcacuccagccugg

SEQ ID NO: 408 - RNA, 20 nt, Homo Sapiens
gccguugcacuccagccugg

SEQ ID NO: 409 - RNA, 23 nt, Homo Sapiens
ugagccacugcacuccagccugg

SEQ ID NO: 410 - RNA, 23 nt, Homo Sapiens
ugcgccacugcacuccagccugg

SEQ ID NO: 411 - RNA, 23 nt, Homo Sapiens
ugcggcacugcacuccagccugg

SEQ ID NO: 412 - RNA, 23 nt, Homo Sapiens
ugcgucauugcacuccagccugg

SEQ ID NO: 413 - RNA, 23 nt, Homo Sapiens
ugugccacugcacuccagccugg

SEQ ID NO: 414 - RNA, 23 nt, Homo Sapiens
ugugucauugcacuccagccugg

SEQ ID NO: 415 - RNA, 19 nt, Homo Sapiens
ugagccgcugcgcccagcc

SEQ ID NO: 416 - RNA, 20 nt, Homo Sapiens
ugagccaccaugcccagccu

SEQ ID NO: 417 - RNA, 21 nt, Homo Sapiens
ugagccacugcgcccggcaug

SEQ ID NO: 418 - RNA, 22 nt, Homo Sapiens
ugagccaccgcgcccagccagg

SEQ ID NO: 419 - RNA, 22 nt, Homo Sapiens
ugagccacugagcccggccugg

SEQ ID NO: 420 - RNA, 22 nt, Homo Sapiens
ugagccacugcacccagccagg

SEQ ID NO: 421 - RNA, 22 nt, Homo Sapiens
ugagccacugugcccggccugg

SEQ ID NO: 422 - RNA, 70 nt, Homo Sapiens
acaugugguguuugguuuccugcuccucuguaaguuugcugaggauaauggcuuccagcuucauccaugu

SEQ ID NO: 423 - RNA, 24 nt, Homo Sapiens
ugugguguuugguuuccugcuccu

SEQ ID NO: 424 - RNA, 24 nt, Homo Sapiens
gguguuuggacucuuuuccuucuc

SEQ ID NO: 425 - RNA, 19 nt, Homo Sapiens
gguguuuggagccuuuccu

SEQ ID NO: 426 - RNA, 24 nt, Homo Sapiens
guggugguucuggccguuuccugc

SEQ ID NO: 427 - RNA, 20 nt, Homo Sapiens
gugguguaaugguuuccugc

SEQ ID NO: 428 - RNA, 23 nt, Homo Sapiens
gugguaggcggcuuccugcuccu

SEQ ID NO: 429 - RNA, 72 nt, Homo Sapiens
acccuagcuaacauccuacagaauggugaaagacugaguguuuuuccccuauaauaggaaacaagcaagggu

SEQ ID NO: 430 - RNA, 24 nt, Homo Sapiens
uaacauccuacagaauggugaaag

SEQ ID NO: 431 - RNA, 25 nt, Homo Sapiens
aacuauccuagccaacauggugaaa

SEQ ID NO: 432 - RNA, 19 nt, Homo Sapiens
aacgagccuucagaauggu

SEQ ID NO: 433 - RNA, 24 nt, Homo Sapiens
aacauccugaccagcauggugaaa

SEQ ID NO: 434 - RNA, 23 nt, Homo Sapiens
aacaucaaagcaugauggugaaa

SEQ ID NO: 435 - RNA, 27 nt, Homo Sapiens
aacauccuacuagauuggguuuggaag

SEQ ID NO: 436 - RNA, 25 nt, Homo Sapiens
aaaauccuacagaucuaugcugaaa

SEQ ID NO: 437 - RNA, 20 nt, Homo Sapiens
acauuucuacagaaugauga

SEQ ID NO: 438 - RNA, 20 nt, Homo Sapiens
acuuucuaucagaaugguga

SEQ ID NO: 439 - RNA, 19 nt, Homo Sapiens
acacacucaggaaugguga

SEQ ID NO: 440 - RNA, 21 nt, Homo Sapiens
acauucuauaguuggugaaag

SEQ ID NO: 441 - RNA, 20 nt, Homo Sapiens
auccaaacagaaugggaaag

SEQ ID NO: 442 - RNA, 18 nt, Homo Sapiens
augcuacagaauugaaag

SEQ ID NO: 443 - RNA, 22 nt, Homo Sapiens
cauccuggacaacauggugaaa

SEQ ID NO: 444 - RNA, 22 nt, Homo Sapiens
cauccugaccaacauggugaaa

SEQ ID NO: 445 - RNA, 22 nt, Homo Sapiens
cagccuagccaguauggugaaa

SEQ ID NO: 446 - RNA, 22 nt, Homo Sapiens
cauccuggccaacauggugaaa

SEQ ID NO: 447 - RNA, 25 nt, Homo Sapiens
uaaaauucugaccaaguggugaaag

SEQ ID NO: 448 - RNA, 24 nt, Homo Sapiens
uaacuuuuacaagagauggugaaa

SEQ ID NO: 449 - RNA, 23 nt, Homo Sapiens
uaaaauccuacaggguucgaaag

SEQ ID NO: 450 - RNA, 20 nt, Homo Sapiens
uaacguucuuaagaauggug

SEQ ID NO: 451 - RNA, 22 nt, Homo Sapiens
uaacauccuagaaaaauugaaa

SEQ ID NO: 452 - RNA, 19 nt, Homo Sapiens
uccuuccaggauggugaaa

SEQ ID NO: 453 - RNA, 61 nt, Homo Sapiens
acuagaauguugaccucgagccgaggccuacuugcagcgcaccggaggagaggucucuagu

SEQ ID NO: 454 - RNA, 24 nt, Homo Sapiens
uagaauguugaccucgagccgagg

SEQ ID NO: 455 - RNA, 24 nt, Homo Sapiens
agaauguuguucugggggccgugg

SEQ ID NO: 456 - RNA, 23 nt, Homo Sapiens
agauugcggagcuggagccgagg

SEQ ID NO: 457 - RNA, 18 nt, Homo Sapiens
uagauguugaccugggcc

SEQ ID NO: 458 - RNA, 23 nt, Homo Sapiens
uagaauguuccagcaagcagagg

SEQ ID NO: 459 - RNA, 62 nt, Homo Sapiens
acuauuaugaucaaggauauggaaauuacaauagugccuaugguggugaucaaaacuauagu

SEQ ID NO: 460 - RNA, 24 nt, Homo Sapiens
uauuaugaucaaggauauggaaau

SEQ ID NO: 461 - RNA, 21 nt, Homo Sapiens
augaccucaaggauagguaaa

SEQ ID NO: 462 - RNA, 21 nt, Homo Sapiens
augucaagagggauauggaaa

SEQ ID NO: 463 - RNA, 20 nt, Homo Sapiens
augaucaaggguguagaaau

SEQ ID NO: 464 - RNA, 23 nt, Homo Sapiens
auuuugcucgagcuauauggaaa

SEQ ID NO: 465 - RNA, 24 nt, Homo Sapiens
auucuuacccaggauauggagaau

SEQ ID NO: 466 - RNA, 20 nt, Homo Sapiens
auuaagauugagauauggaa

SEQ ID NO: 467 - RNA, 21 nt, Homo Sapiens
auuauuuaaaguauauggaaa

SEQ ID NO: 468 - RNA, 19 nt, Homo Sapiens
uaugaucaaaagagaugga

SEQ ID NO: 469 - RNA, 20 nt, Homo Sapiens
uaugaucaaauauacagaaa

SEQ ID NO: 470 - RNA, 26 nt, Homo Sapiens
uauuauugaacuagagauauggaaau

SEQ ID NO: 471 - RNA, 25 nt, Homo Sapiens
uauuaugaucagguagauuugggaa

SEQ ID NO: 472 - RNA, 26 nt, Homo Sapiens
uauaaugaucaagcaacccuggaaau

SEQ ID NO: 473 - RNA, 22 nt, Homo Sapiens
uauucuaggcaaggauaugaaa

SEQ ID NO: 474 - RNA, 23 nt, Homo Sapiens
uauaauuagaaaugauauggaaa

SEQ ID NO: 475 - RNA, 23 nt, Homo Sapiens
uaguaaguuuaaaguauggaaau

SEQ ID NO: 476 - RNA, 22 nt, Homo Sapiens
uauuuuguuccuguauggaaau

SEQ ID NO: 477 - RNA, 20 nt, Homo Sapiens
uuauuauacugauauggaaa

SEQ ID NO: 478 - RNA, 21 nt, Homo Sapiens
uuauauaaaacauauggaaau

SEQ ID NO: 479 - RNA, 20 nt, Homo Sapiens
uuuugaaaaaauauggaaau

SEQ ID NO: 480 - RNA, 63 nt, Homo Sapiens
agagccggcugggagaggcggcgucaggguggguccugcgccugcccuuuccgcgccggcuuu

SEQ ID NO: 481 - RNA, 24 nt, Homo Sapiens
ugcgccugcccuuuccgcgccggc

SEQ ID NO: 482 - RNA, 21 nt, Homo Sapiens
ccugcccuuucccuggccccg

SEQ ID NO: 483 - RNA, 20 nt, Homo Sapiens
ccugcccuugccgccgccgg

SEQ ID NO: 484 - RNA, 20 nt, Homo Sapiens
cccgcccccgccgcgccggc

SEQ ID NO: 485 - RNA, 20 nt, Homo Sapiens
cgcgcuguccucgcgccggc

SEQ ID NO: 486 - RNA, 23 nt, Homo Sapiens
cgccugccccaaaccgcgcgggc

SEQ ID NO: 487 - RNA, 23 nt, Homo Sapiens
cgccagcucggucccgcgccggc

SEQ ID NO: 488 - RNA, 22 nt, Homo Sapiens
cggcuccccuuccgcgcccggc

SEQ ID NO: 489 - RNA, 18 nt, Homo Sapiens
cgccgccccuccgcgccg

SEQ ID NO: 490 - RNA, 21 nt, Homo Sapiens
cgccucccccgccgcgccggc

SEQ ID NO: 491 - RNA, 22 nt, Homo Sapiens
gccucccuugcggcgcgccggc

SEQ ID NO: 492 - RNA, 19 nt, Homo Sapiens
gccugcccuucccugcccc

SEQ ID NO: 493 - RNA, 17 nt, Homo Sapiens
gccugcacuccgcgccg

SEQ ID NO: 494 - RNA, 20 nt, Homo Sapiens
gccugcccuuuuggcccagg

SEQ ID NO: 495 - RNA, 20 nt, Homo Sapiens
gccuucggucuccgcgccgg

SEQ ID NO: 496 - RNA, 21 nt, Homo Sapiens
gcccgcacgacccgcgccggc

SEQ ID NO: 497 - RNA, 24 nt, Homo Sapiens
gcgccucgggccggcuccgcgccg

SEQ ID NO: 498 - RNA, 23 nt, Homo Sapiens
gcgcccggcuccccuuccgcgcc

SEQ ID NO: 499 - RNA, 26 nt, Homo Sapiens
gcgcccgcgcccugcagcgcgccggc

SEQ ID NO: 500 - RNA, 24 nt, Homo Sapiens
gcgccugccgcugcccuggccggc

SEQ ID NO: 501 - RNA, 23 nt, Homo Sapiens
gcgccugcccuguaacgcgaccg

SEQ ID NO: 502 - RNA, 17 nt, Homo Sapiens
gcgccugcccugcgcgc

SEQ ID NO: 503 - RNA, 20 nt, Homo Sapiens
gcgcgucggcuuuccgcgcc

SEQ ID NO: 504 - RNA, 19 nt, Homo Sapiens
gcgcccggccuccgcgccg

SEQ ID NO: 505 - RNA, 21 nt, Homo Sapiens
gcgccggcagucuccgcgccg

SEQ ID NO: 506 - RNA, 20 nt, Homo Sapiens
gcgccugccgguccucgccg

SEQ ID NO: 507 - RNA, 19 nt, Homo Sapiens
gcgccugcccagcgcgccg

SEQ ID NO: 508 - RNA, 19 nt, Homo Sapiens
gcggcggccuccgcgccgg

SEQ ID NO: 509 - RNA, 19 nt, Homo Sapiens
gccccugccccgcgccggc

SEQ ID NO: 510 - RNA, 21 nt, Homo Sapiens
gcgccccaaucccgcgccggc

SEQ ID NO: 511 - RNA, 20 nt, Homo Sapiens
gcgccugccgccgcggcggc

SEQ ID NO: 512 - RNA, 22 nt, Homo Sapiens
gcgucuggcucugcgcgccggc

SEQ ID NO: 513 - RNA, 23 nt, Homo Sapiens
ugcagccagcccuuuccccagcc

SEQ ID NO: 514 - RNA, 25 nt, Homo Sapiens
ugcgccugcaccgucccuccccugc

SEQ ID NO: 515 - RNA, 25 nt, Homo Sapiens
ugcgccugcgccgcuccucuccugc

SEQ ID NO: 516 - RNA, 23 nt, Homo Sapiens
ugagccucccgcucuccgcgccg

SEQ ID NO: 517 - RNA, 22 nt, Homo Sapiens
ugcgccugcucccgccgcccgc

SEQ ID NO: 518 - RNA, 19 nt, Homo Sapiens
ugcgccugccuccgcugcc

SEQ ID NO: 519 - RNA, 17 nt, Homo Sapiens
ugcgccugcccugcgcc

SEQ ID NO: 520 - RNA, 22 nt, Homo Sapiens
ugagccugcccuuccucucggg

SEQ ID NO: 521 - RNA, 22 nt, Homo Sapiens
ugcggccgccucccgcgccggc

SEQ ID NO: 522 - RNA, 87 nt, Homo Sapiens
agaggaagcgggaggagcugagcaacguacuggccgccaugaggaaagcugcugccaaugaaagacugagccccuccccugcccucu

SEQ ID NO: 523 - RNA, 24 nt, Homo Sapiens
gaaagacugagccccuccccugcc

SEQ ID NO: 524 - RNA, 20 nt, Homo Sapiens
aaagacugacuccgccccug

SEQ ID NO: 525 - RNA, 17 nt, Homo Sapiens
aagacaaccccuccccu

SEQ ID NO: 526 - RNA, 24 nt, Homo Sapiens
agucuggcagccccuccucgugcc

SEQ ID NO: 527 - RNA, 18 nt, Homo Sapiens
agacgccccuccccuacc

SEQ ID NO: 528 - RNA, 23 nt, Homo Sapiens
cugagccuccgagcuccccugcc

SEQ ID NO: 529 - RNA, 24 nt, Homo Sapiens
gaaagacuguccuccccccucugc

SEQ ID NO: 530 - RNA, 20 nt, Homo Sapiens
gaccgaguccccuccccggc

SEQ ID NO: 531 - RNA, 68 nt, Homo Sapiens
agauaaaagguuucuaaaacaugacggagguugagaugaagcuucuucauggaguaaaaaauguauuu

SEQ ID NO: 532 - RNA, 24 nt, Homo Sapiens
uaaaagguuucuaaaacaugacgg

SEQ ID NO: 533 - RNA, 25 nt, Homo Sapiens
aaaauguaucuacaaaacaugaugg

SEQ ID NO: 534 - RNA, 22 nt, Homo Sapiens
aaaaucuugcuacaaacaugac

SEQ ID NO: 535 - RNA, 24 nt, Homo Sapiens
aaauguauccucaaaacaugaugg

SEQ ID NO: 536 - RNA, 20 nt, Homo Sapiens
aaaaauuucuuaaacaugac

SEQ ID NO: 537 - RNA, 19 nt, Homo Sapiens
aggacucaugaaacaugac

SEQ ID NO: 538 - RNA, 21 nt, Homo Sapiens
uaaacucagguuucuaaauca

SEQ ID NO: 539 - RNA, 22 nt, Homo Sapiens
uaaagggauuuuuaaaacauga

SEQ ID NO: 540 - RNA, 23 nt, Homo Sapiens
uaaaagguuuuuaaaaacaguga

SEQ ID NO: 541 - RNA, 16 nt, Homo Sapiens
uaaaagguuuaaacau

SEQ ID NO: 542 - RNA, 19 nt, Homo Sapiens
uaacugguuccuaaaacau

SEQ ID NO: 543 - RNA, 20 nt, Homo Sapiens
uaaaaugaguuuaaaacaug

SEQ ID NO: 544 - RNA, 22 nt, Homo Sapiens
uaaaagguuuaaaacauuaagg

SEQ ID NO: 545 - RNA, 69 nt, Homo Sapiens
agauaccauacacaugaugaaguugcuguuugaaaguacuguugaagcacuguacaaguuugugguucu

SEQ ID NO: 546 - RNA, 24 nt, Homo Sapiens
uaccauacacaugaugaaguugcu

SEQ ID NO: 547 - RNA, 18 nt, Homo Sapiens
acaaucaaugaugaaguu

SEQ ID NO: 548 - RNA, 22 nt, Homo Sapiens
accaugcuuauaugaaguugcu

SEQ ID NO: 549 - RNA, 18 nt, Homo Sapiens
auacacauguuaaauugc

SEQ ID NO: 550 - RNA, 22 nt, Homo Sapiens
cauacaacaugaugaacaugcu

SEQ ID NO: 551 - RNA, 18 nt, Homo Sapiens
ccaacacaugauguaagu

SEQ ID NO: 552 - RNA, 20 nt, Homo Sapiens
ccauacacauacugaucuug

SEQ ID NO: 553 - RNA, 19 nt, Homo Sapiens
ccauacacaugaguauuug

SEQ ID NO: 554 - RNA, 22 nt, Homo Sapiens
uaccauacauaugcaaagaagu

SEQ ID NO: 555 - RNA, 19 nt, Homo Sapiens
uacuauacugugaaguugc

SEQ ID NO: 556 - RNA, 62 nt, Homo Sapiens
agaucagauggucguaguuguguggcuuuauuucugaguucucuuaacuguuccauuggucu

SEQ ID NO: 557 - RNA, 24 nt, Homo Sapiens
ucagauggucguaguuguguggcu

SEQ ID NO: 558 - RNA, 22 nt, Homo Sapiens
gaucgucguaguugugcuuggc

SEQ ID NO: 559 - RNA, 18 nt, Homo Sapiens
gauggucgucgggggugg

SEQ ID NO: 560 - RNA, 21 nt, Homo Sapiens
ucagauggugauugucuugcu

SEQ ID NO: 561 - RNA, 63 nt, Homo Sapiens
agaugacguuuaugaucguaugcugcuagacuacuucuuuucuuaucaucaguucauccaucu

SEQ ID NO: 562 - RNA, 24 nt, Homo Sapiens
ugacguuuaugaucguaugcugcu

SEQ ID NO: 563 - RNA, 19 nt, Homo Sapiens
cguuuaugacaugaugcug

SEQ ID NO: 564 - RNA, 18 nt, Homo Sapiens
cguuuaugacuguuucug

SEQ ID NO: 565 - RNA, 18 nt, Homo Sapiens
gacguuuauuaacucugc

SEQ ID NO: 566 - RNA, 24 nt, Homo Sapiens
guuuauggguaauugguaugcugc

SEQ ID NO: 567 - RNA, 28 nt, Homo Sapiens
ugacugguauaugcccugcuaugcugcu

SEQ ID NO: 568 - RNA, 22 nt, Homo Sapiens
ugacguuuauugagggucugcu

SEQ ID NO: 569 - RNA, 20 nt, Homo Sapiens
ugacguuuaaaagcacaugc

SEQ ID NO: 570 - RNA, 19 nt, Homo Sapiens
uuuaugauccaaguauacu

SEQ ID NO: 571 - RNA, 18 nt, Homo Sapiens
uuuaugaucucuguuucu

SEQ ID NO: 572 - RNA, 19 nt, Homo Sapiens
uuuuuuuucauaugcugcu

SEQ ID NO: 573 - RNA, 64 nt, Homo Sapiens
agaugaggucucagaugcgagaucaacucuaauacgaaauccaucugcaaucugggccccauuu

SEQ ID NO: 574 - RNA, 24 nt, Homo Sapiens
ugaggucucagaugcgagaucaac

SEQ ID NO: 575 - RNA, 23 nt, Homo Sapiens
aggucucagagaagcaagaauca

SEQ ID NO: 576 - RNA, 24 nt, Homo Sapiens
aggucucaguggaggacgggauca

SEQ ID NO: 577 - RNA, 21 nt, Homo Sapiens
aggucucagaggaugugugau

SEQ ID NO: 578 - RNA, 21 nt, Homo Sapiens
aguucucagaugaaacuagau

SEQ ID NO: 579 - RNA, 20 nt, Homo Sapiens
aggucucagaugcguaguuc

SEQ ID NO: 580 - RNA, 19 nt, Homo Sapiens
aggucucagcugaaaguca

SEQ ID NO: 581 - RNA, 18 nt, Homo Sapiens
aggucucaguugaaucaa

SEQ ID NO: 582 - RNA, 21 nt, Homo Sapiens
aguucuggguuggagaucaac

SEQ ID NO: 583 - RNA, 21 nt, Homo Sapiens
gaggcugagaugcgaggauca

SEQ ID NO: 584 - RNA, 19 nt, Homo Sapiens
gaggucucagcucacauca

SEQ ID NO: 585 - RNA, 17 nt, Homo Sapiens
gucucagaugaggacaa

SEQ ID NO: 586 - RNA, 18 nt, Homo Sapiens
ucucagaugaggauccac

SEQ ID NO: 587 - RNA, 21 nt, Homo Sapiens
ugaggucucaacaugggugau

SEQ ID NO: 588 - RNA, 67 nt, Homo Sapiens
agcaaucaaagguuuucgcaauucuccagugggaguaaaccacagacuacgagggaguuugacagcu

SEQ ID NO: 589 - RNA, 24 nt, Homo Sapiens
ucaaagguuuucgcaauucuccag

SEQ ID NO: 590 - RNA, 27 nt, Homo Sapiens
aaagguugauucgcauagauucuccag

SEQ ID NO: 591 - RNA, 18 nt, Homo Sapiens
aaagguuuuccuauucuc

SEQ ID NO: 592 - RNA, 22 nt, Homo Sapiens
aagauuuccacgcaauucucca

SEQ ID NO: 593 - RNA, 20 nt, Homo Sapiens
agguugugauaauucuccag

SEQ ID NO: 594 - RNA, 25 nt, Homo Sapiens
caaagagacuucucccaauucucca

SEQ ID NO: 595 - RNA, 21 nt, Homo Sapiens
cauauguauuuccaauucucc

SEQ ID NO: 596 - RNA, 23 nt, Homo Sapiens
cacaggcucuggccaauucucca

SEQ ID NO: 597 - RNA, 19 nt, Homo Sapiens
caaagguuugccacauucu

SEQ ID NO: 598 - RNA, 20 nt, Homo Sapiens
caacagauuucgcaauuuuc

SEQ ID NO: 599 - RNA, 22 nt, Homo Sapiens
caaagguuuucacauucugcag

SEQ ID NO: 600 - RNA, 21 nt, Homo Sapiens
ucaaagguugucugcauauuc

SEQ ID NO: 601 - RNA, 22 nt, Homo Sapiens
ucacagguucaagcaauucucc

SEQ ID NO: 602 - RNA, 22 nt, Homo Sapiens
ucauggguucaagcaauucucc

SEQ ID NO: 603 - RNA, 22 nt, Homo Sapiens
uccaagguucgagcaauucucc

SEQ ID NO: 604 - RNA, 79 nt, Homo Sapiens
agcaugacugacacgucugaccccugagaagguggucucugccuuccuaaaggugucaucuguguucaaggacgaagcu

SEQ ID NO: 605 - RNA, 24 nt, Homo Sapiens
ugacacgucugaccccugagaagg

SEQ ID NO: 606 - RNA, 21 nt, Homo Sapiens
acaggccuguguccugagaag

SEQ ID NO: 607 - RNA, 24 nt, Homo Sapiens
caaguccuugaccccuggagcagg

SEQ ID NO: 608 - RNA, 21 nt, Homo Sapiens
caggucugaccccagcuaagg

SEQ ID NO: 609 - RNA, 23 nt, Homo Sapiens
gacaguuccucuggccccugaga

SEQ ID NO: 610 - RNA, 20 nt, Homo Sapiens
gacacuucuccaccccugag

SEQ ID NO: 611 - RNA, 21 nt, Homo Sapiens
gaccagccugucccugagaag

SEQ ID NO: 612 - RNA, 17 nt, Homo Sapiens
ugacaccugaccccuga

SEQ ID NO: 613 - RNA, 18 nt, Homo Sapiens
ugccacacugaccccuga

SEQ ID NO: 614 - RNA, 22 nt, Homo Sapiens
ugaccgguaagaccccugaaaa

SEQ ID NO: 615 - RNA, 20 nt, Homo Sapiens
ugacaccuaacccugagaag

SEQ ID NO: 616 - RNA, 24 nt, Homo Sapiens
ugacacuuuauuccccugagaggg

SEQ ID NO: 617 - RNA, 63 nt, Homo Sapiens
agcauuccaacaaaggguuuuaauguagauuuuuuuuuuuugcaccccaugcuguugauugcu

SEQ ID NO: 618 - RNA, 24 nt, Homo Sapiens
uuccaacaaaggguuuuaauguag

SEQ ID NO: 619 - RNA, 19 nt, Homo Sapiens
aacaaaacagguuuuaaug

SEQ ID NO: 620 - RNA, 20 nt, Homo Sapiens
caacaaaggguuucagugua

SEQ ID NO: 621 - RNA, 20 nt, Homo Sapiens
ccaagcagaaugguuuuaau

SEQ ID NO: 622 - RNA, 23 nt, Homo Sapiens
uccuacacgaaggguuuugaugu

SEQ ID NO: 623 - RNA, 24 nt, Homo Sapiens
uccaccaagaaggguuuuuuugua

SEQ ID NO: 624 - RNA, 25 nt, Homo Sapiens
uucaaagccaaaggguuuauuauag

SEQ ID NO: 625 - RNA, 19 nt, Homo Sapiens
uucccucaaaaggguuuua

SEQ ID NO: 626 - RNA, 19 nt, Homo Sapiens
uuccaacaauuucuuuuaa

SEQ ID NO: 627 - RNA, 21 nt, Homo Sapiens
uuccaacaaagcgcuuuacug

SEQ ID NO: 628 - RNA, 21 nt, Homo Sapiens
uucuagaaaaugguuuuaaug

SEQ ID NO: 629 - RNA, 24 nt, Homo Sapiens
uuccaacaaaucuuuuaaauuuag

SEQ ID NO: 630 - RNA, 70 nt, Homo Sapiens
agccagucauucuaaggggcuuuguauuggugcuauaaagucaaccucaauuccuuacaguggucugguu

SEQ ID NO: 631 - RNA, 24 nt, Homo Sapiens
uaaagucaaccucaauuccuuaca

SEQ ID NO: 632 - RNA, 20 nt, Homo Sapiens
aaagucaacguucuucauuc

SEQ ID NO: 633 - RNA, 19 nt, Homo Sapiens
aaagucaaccaucuauucc

SEQ ID NO: 634 - RNA, 22 nt, Homo Sapiens
aaaaucacacugcaauuccuua

SEQ ID NO: 635 - RNA, 22 nt, Homo Sapiens
aaagucaccucaauucucucac

SEQ ID NO: 636 - RNA, 21 nt, Homo Sapiens
aaagugagacaaaauuccuua

SEQ ID NO: 637 - RNA, 20 nt, Homo Sapiens
aaaguaaacaauuccuuuca

SEQ ID NO: 638 - RNA, 22 nt, Homo Sapiens
aaugugaaccucaauaauuaca

SEQ ID NO: 639 - RNA, 21 nt, Homo Sapiens
aaccuccuauuaauuccuuac

SEQ ID NO: 640 - RNA, 22 nt, Homo Sapiens
aagcuaagcuuuauuccuuaca

SEQ ID NO: 641 - RNA, 21 nt, Homo Sapiens
agucacaugcaauuccuuuca

SEQ ID NO: 642 - RNA, 18 nt, Homo Sapiens
agucaaccuaaaaccuua

SEQ ID NO: 643 - RNA, 20 nt, Homo Sapiens
uaaaguuuaagccucaauuc

SEQ ID NO: 644 - RNA, 23 nt, Homo Sapiens
uaaagucaacacaacacuccuua

SEQ ID NO: 645 - RNA, 19 nt, Homo Sapiens
uaaagucaacauuuuuucc

SEQ ID NO: 646 - RNA, 20 nt, Homo Sapiens
uaaagucaaaucaaauacuu

SEQ ID NO: 647 - RNA, 20 nt, Homo Sapiens
uaaagucaauccaagucuuu

SEQ ID NO: 648 - RNA, 21 nt, Homo Sapiens
uauagagaaccucaaucucuu

SEQ ID NO: 649 - RNA, 21 nt, Homo Sapiens
uaaaaccaaccucaaaucuua

SEQ ID NO: 650 - RNA, 22 nt, Homo Sapiens
uaaagucaaaauuauucuuuac

SEQ ID NO: 651 - RNA, 20 nt, Homo Sapiens
ucaaccucaaauucccuuca

SEQ ID NO: 652 - RNA, 88 nt, Homo Sapiens
agcccucgaugagaacaaggucacggucagcugauuuacuugagcguucggcuuacucugaccugacacacuccacagagcacuggcu

SEQ ID NO: 653 - RNA, 24 nt, Homo Sapiens
ugagaacaaggucacggucagcug

SEQ ID NO: 654 - RNA, 21 nt, Homo Sapiens
aacuagagagacacggucagc

SEQ ID NO: 655 - RNA, 18 nt, Homo Sapiens
acacaggucacggagcug

SEQ ID NO: 656 - RNA, 19 nt, Homo Sapiens
acaaggucaguaacagcug

SEQ ID NO: 657 - RNA, 19 nt, Homo Sapiens
agaacaagggguucaaggu

SEQ ID NO: 658 - RNA, 23 nt, Homo Sapiens
agcacacccucacuggucagcug

SEQ ID NO: 659 - RNA, 20 nt, Homo Sapiens
agagcacggcuggucagcug

SEQ ID NO: 660 - RNA, 19 nt, Homo Sapiens
gaagcaaggucacugguca

SEQ ID NO: 661 - RNA, 24 nt, Homo Sapiens
gagaacaaguuuccacugccagcu

SEQ ID NO: 662 - RNA, 19 nt, Homo Sapiens
gagaacaaggucucugcag

SEQ ID NO: 663 - RNA, 21 nt, Homo Sapiens
gagaacaagauagaucagaug

SEQ ID NO: 664 - RNA, 21 nt, Homo Sapiens
gaggacagggcaggucagcug

SEQ ID NO: 665 - RNA, 20 nt, Homo Sapiens
ugaggaagacagucacgguc

SEQ ID NO: 666 - RNA, 21 nt, Homo Sapiens
ugggauacaggucacgggcag

SEQ ID NO: 667 - RNA, 21 nt, Homo Sapiens
ugagaacaacuggccaagguc

SEQ ID NO: 668 - RNA, 20 nt, Homo Sapiens
ugugaacaaggucuggacgg

SEQ ID NO: 669 - RNA, 24 nt, Homo Sapiens
ugagaacaaagucuauguggcagc

SEQ ID NO: 670 - RNA, 20 nt, Homo Sapiens
ugagaacaaguccagggcag

SEQ ID NO: 671 - RNA, 19 nt, Homo Sapiens
ugagaacaagugcagucag

SEQ ID NO: 672 - RNA, 23 nt, Homo Sapiens
ugagaauaaauuagggucagcug

SEQ ID NO: 673 - RNA, 64 nt, Homo Sapiens
agccggguugcgccaggcugucauaguccuucucguggaacacggcggcgcggucacccaggcu

SEQ ID NO: 674 - RNA, 24 nt, Homo Sapiens
acacggcggcgcggucacccaggc

SEQ ID NO: 675 - RNA, 19 nt, Homo Sapiens
cacggcggcgggaccccag

SEQ ID NO: 676 - RNA, 21 nt, Homo Sapiens
cgcgcggcagcucauaguccu

SEQ ID NO: 677 - RNA, 19 nt, Homo Sapiens
cgccaggcugucaugggcc

SEQ ID NO: 678 - RNA, 21 nt, Homo Sapiens
cgccaggcucacaucucccuu

SEQ ID NO: 679 - RNA, 20 nt, Homo Sapiens
cggggugggcucacccaggc

SEQ ID NO: 680 - RNA, 20 nt, Homo Sapiens
gccaggcuguggucaguccu

SEQ ID NO: 681 - RNA, 18 nt, Homo Sapiens
gccaggcuguucuauccu

SEQ ID NO: 682 - RNA, 20 nt, Homo Sapiens
gccaggcugccucagucauu

SEQ ID NO: 683 - RNA, 20 nt, Homo Sapiens
gcgccaggcuggcuuagccc

SEQ ID NO: 684 - RNA, 24 nt, Homo Sapiens
ggcggcagugggggucacccaggc

SEQ ID NO: 685 - RNA, 20 nt, Homo Sapiens
ggcggcucgcgcacccaggc

SEQ ID NO: 686 - RNA, 20 nt, Homo Sapiens
ggcugcuugggcacccaggc

SEQ ID NO: 687 - RNA, 18 nt, Homo Sapiens
ugcuccaggcuguagucc

SEQ ID NO: 688 - RNA, 21 nt, Homo Sapiens
ugcgccaggucccauaguacu

SEQ ID NO: 689 - RNA, 21 nt, Homo Sapiens
ugcucgagucagcauaguccu

SEQ ID NO: 690 - RNA, 24 nt, Homo Sapiens
uugcccaggcugugucaaacuccu

SEQ ID NO: 691 - RNA, 25 nt, Homo Sapiens
uuggccaggcuggccucaaacuccu

SEQ ID NO: 692 - RNA, 25 nt, Homo Sapiens
uuggccaggcuggucucaaacuccu

SEQ ID NO: 693 - RNA, 25 nt, Homo Sapiens
uuggccaggcuggucucgaaguccu

SEQ ID NO: 694 - RNA, 24 nt, Homo Sapiens
uuggccaggcuggcucaaacuccu

SEQ ID NO: 695 - RNA, 25 nt, Homo Sapiens
uuggccaggcugcucuugaacuccu

SEQ ID NO: 696 - RNA, 21 nt, Homo Sapiens
uuggccaaggucauagucauu

SEQ ID NO: 697 - RNA, 62 nt, Homo Sapiens
agccucacagcucaggucucucuuugccugucacaguggaagucccgugcugagcccagguu

SEQ ID NO: 698 - RNA, 24 nt, Homo Sapiens
ucacagcucaggucucucuuugcc

SEQ ID NO: 699 - RNA, 17 nt, Homo Sapiens
acagcugcucucucuuu

SEQ ID NO: 700 - RNA, 20 nt, Homo Sapiens
acaacccaggucucuuucug

SEQ ID NO: 701 - RNA, 20 nt, Homo Sapiens
acagcucagacccucuuggc

SEQ ID NO: 702 - RNA, 22 nt, Homo Sapiens
acagcucagcccccucauuacc

SEQ ID NO: 703 - RNA, 22 nt, Homo Sapiens
agcacaguggucccucuuugcc

SEQ ID NO: 704 - RNA, 23 nt, Homo Sapiens
cagagacuuaaguucucuuugcc

SEQ ID NO: 705 - RNA, 20 nt, Homo Sapiens
cacagcucagugacacucuu

SEQ ID NO: 706 - RNA, 22 nt, Homo Sapiens
cacagcucagaguaucaccuug

SEQ ID NO: 707 - RNA, 22 nt, Homo Sapiens
cacagcucaagucuggcuguuu

SEQ ID NO: 708 - RNA, 17 nt, Homo Sapiens
cacaccuggucucucuu

SEQ ID NO: 709 - RNA, 21 nt, Homo Sapiens
cagagcugaaaucucucuuug

SEQ ID NO: 710 - RNA, 22 nt, Homo Sapiens
cacagcucaggcucuuucagcc

SEQ ID NO: 711 - RNA, 23 nt, Homo Sapiens
cagguccgaggucucucucuucc

SEQ ID NO: 712 - RNA, 20 nt, Homo Sapiens
caucucaggucuacucuaug

SEQ ID NO: 713 - RNA, 19 nt, Homo Sapiens
cucuggaccucucuuugcc

SEQ ID NO: 714 - RNA, 19 nt, Homo Sapiens
cucuugucucucuuuagcc

SEQ ID NO: 715 - RNA, 19 nt, Homo Sapiens
gcuccgguuuucucuuugc

SEQ ID NO: 716 - RNA, 18 nt, Homo Sapiens
gcucauguccucuuugcc

SEQ ID NO: 717 - RNA, 23 nt, Homo Sapiens
ucacagcuccagagcccucguug

SEQ ID NO: 718 - RNA, 23 nt, Homo Sapiens
ucacagcucaaaauugcucuuug

SEQ ID NO: 719 - RNA, 20 nt, Homo Sapiens
ucacaucucugggucucucu

SEQ ID NO: 720 - RNA, 22 nt, Homo Sapiens
ucaaccucggauccucuuugcc

SEQ ID NO: 721 - RNA, 62 nt, Homo Sapiens
agccugagacuaguucggacuccccuucggcaaggucgaaggggguucggcuggucucugcu

SEQ ID NO: 722 - RNA, 24 nt, Homo Sapiens
ugagacuaguucggacuccccuuc

SEQ ID NO: 723 - RNA, 24 nt, Homo Sapiens
agacauuuguuccaacuccccuuc

SEQ ID NO: 724 - RNA, 18 nt, Homo Sapiens
agacaagcagacuccccu

SEQ ID NO: 725 - RNA, 19 nt, Homo Sapiens
gacuucgcucggacucccc

SEQ ID NO: 726 - RNA, 19 nt, Homo Sapiens
gacuggggcuggacucccc

SEQ ID NO: 727 - RNA, 19 nt, Homo Sapiens
gaauaggccugacuccccu

SEQ ID NO: 728 - RNA, 19 nt, Homo Sapiens
gacagggcggacucccuuc

SEQ ID NO: 729 - RNA, 25 nt, Homo Sapiens
gagacggggcuccgcacuccccuuc

SEQ ID NO: 730 - RNA, 17 nt, Homo Sapiens
gagacuaguucucuccc

SEQ ID NO: 731 - RNA, 19 nt, Homo Sapiens
gagacuaguucucucuccc

SEQ ID NO: 732 - RNA, 16 nt, Homo Sapiens
gagacagggacucccc

SEQ ID NO: 733 - RNA, 19 nt, Homo Sapiens
ugaugauuagggacucccc

SEQ ID NO: 734 - RNA, 20 nt, Homo Sapiens
ugaaacuauagggacucccc

SEQ ID NO: 735 - RNA, 20 nt, Homo Sapiens
ugagacuaucaacuccccuu

SEQ ID NO: 736 - RNA, 21 nt, Homo Sapiens
ugagaaguggaacuccccuuc

SEQ ID NO: 737 - RNA, 68 nt, Homo Sapiens
agccuuuauugggucagggcuugcuccagagcucaggggccagguaggucaggagccuugggauggcu

SEQ ID NO: 738 - RNA, 24 nt, Homo Sapiens
uauugggucagggcuugcuccaga

SEQ ID NO: 739 - RNA, 24 nt, Homo Sapiens
auugggucaggguguggacucuag

SEQ ID NO: 740 - RNA, 20 nt, Homo Sapiens
gggucaggggcccuuguucc

SEQ ID NO: 741 - RNA, 20 nt, Homo Sapiens
gggucagggcuggcuggaga

SEQ ID NO: 742 - RNA, 20 nt, Homo Sapiens
ucagggcuucagguuccaga

SEQ ID NO: 743 - RNA, 19 nt, Homo Sapiens
ugggucagggcucugccca

SEQ ID NO: 744 - RNA, 21 nt, Homo Sapiens
ugggcagggcuugcccuccag

SEQ ID NO: 745 - RNA, 22 nt, Homo Sapiens
uuggagucacaggcuugcucca

SEQ ID NO: 746 - RNA, 24 nt, Homo Sapiens
uuaggucagggcugcuugccccag

SEQ ID NO: 747 - RNA, 19 nt, Homo Sapiens
uugggucaggggugcccag

SEQ ID NO: 748 - RNA, 86 nt, Homo Sapiens
agcgggaucgcuucgggugcucgacuccuguugcgcaugcucagcgcgcugcccggcuggggacccgcgcaccugcagcgcccgcu

SEQ ID NO: 749 - RNA, 24 nt, Homo Sapiens
gcccggcuggggacccgcgcaccu

SEQ ID NO: 750 - RNA, 22 nt, Homo Sapiens
cccggacucggcucgcgcaccu

SEQ ID NO: 751 - RNA, 20 nt, Homo Sapiens
cccggcuggcggcgccgcgc

SEQ ID NO: 752 - RNA, 19 nt, Homo Sapiens
cccggcuggggacgcagcg

SEQ ID NO: 753 - RNA, 23 nt, Homo Sapiens
cccagguggggacccucaggacc

SEQ ID NO: 754 - RNA, 20 nt, Homo Sapiens
cccggcuggaguccggcaca

SEQ ID NO: 755 - RNA, 19 nt, Homo Sapiens
cccugguggggacccggca

SEQ ID NO: 756 - RNA, 23 nt, Homo Sapiens
cccggcugggccgcggggcaccu

SEQ ID NO: 757 - RNA, 26 nt, Homo Sapiens
ccggcugggccgggaccgcgcgcgcc

SEQ ID NO: 758 - RNA, 20 nt, Homo Sapiens
ccggcugggccagcgccccu

SEQ ID NO: 759 - RNA, 20 nt, Homo Sapiens
cggcuggggccuccacagca

SEQ ID NO: 760 - RNA, 22 nt, Homo Sapiens
cggcuggggacacugcccagcu

SEQ ID NO: 761 - RNA, 20 nt, Homo Sapiens
cggcgcgcgacccgcgcucc

SEQ ID NO: 762 - RNA, 20 nt, Homo Sapiens
cggcuggggccccacccccc

SEQ ID NO: 763 - RNA, 19 nt, Homo Sapiens
cuggggaccugcagccccu

SEQ ID NO: 764 - RNA, 19 nt, Homo Sapiens
gcccagaggcuggggaccc

SEQ ID NO: 765 - RNA, 21 nt, Homo Sapiens
gcccuggcuggggaugcaccu

SEQ ID NO: 766 - RNA, 25 nt, Homo Sapiens
gcccagcguuggggacccucccucc

SEQ ID NO: 767 - RNA, 23 nt, Homo Sapiens
gcccgccguggcuccccgcgcac

SEQ ID NO: 768 - RNA, 19 nt, Homo Sapiens
gcccggcugcuggaccgcg

SEQ ID NO: 769 - RNA, 19 nt, Homo Sapiens
gccuggcuggggagcccgc

SEQ ID NO: 770 - RNA, 21 nt, Homo Sapiens
gcccacuggggacccagcuca

SEQ ID NO: 771 - RNA, 16 nt, Homo Sapiens
gcccggcuggcccgcg

SEQ ID NO: 772 - RNA, 18 nt, Homo Sapiens
gccccaggggacccgagc

SEQ ID NO: 773 - RNA, 18 nt, Homo Sapiens
gcccggcuggagcgcacc

SEQ ID NO: 774 - RNA, 23 nt, Homo Sapiens
gcuggggacaaccguggacaccu

SEQ ID NO: 775 - RNA, 19 nt, Homo Sapiens
gccggagucuccgcgcacc

SEQ ID NO: 776 - RNA, 19 nt, Homo Sapiens
gcuggggacuccgcccccu

SEQ ID NO: 777 - RNA, 21 nt, Homo Sapiens
gcuggggacccggggcagccu

SEQ ID NO: 778 - RNA, 19 nt, Homo Sapiens
ggcuggggaugcccggcac

SEQ ID NO: 779 - RNA, 21 nt, Homo Sapiens
ggcuggggaccacacacgcac

SEQ ID NO: 780 - RNA, 18 nt, Homo Sapiens
ggcggggacccgcacucc

SEQ ID NO: 781 - RNA, 18 nt, Homo Sapiens
ggcuggggacgcgcuccu

SEQ ID NO: 782 - RNA, 62 nt, Homo Sapiens
agcgggauggcugcagccaaggagcugggggagggccgggcucagggcuagcccuuuccgcu

SEQ ID NO: 783 - RNA, 21 nt, Homo Sapiens
ucagggcuagcccuuuccgcu

SEQ ID NO: 784 - RNA, 19 nt, Homo Sapiens
aggcccagcccuuuccccu

SEQ ID NO: 785 - RNA, 19 nt, Homo Sapiens
cagggcuagcggugucugc

SEQ ID NO: 786 - RNA, 19 nt, Homo Sapiens
cagugcagcccuuucagcu

SEQ ID NO: 787 - RNA, 22 nt, Homo Sapiens
gggcuagacgccaccuuuccgc

SEQ ID NO: 788 - RNA, 22 nt, Homo Sapiens
ucaguaggcuggggcccuuucc

SEQ ID NO: 789 - RNA, 23 nt, Homo Sapiens
ucaggcgcccagcccuuucucgc

SEQ ID NO: 790 - RNA, 20 nt, Homo Sapiens
ucagcacagcccuuucagcu

SEQ ID NO: 791 - RNA, 21 nt, Homo Sapiens
ucagggcuagcccucuccgcu

SEQ ID NO: 792 - RNA, 131 nt, Homo Sapiens
agcuucacgcucuuugucauccuggacuucuucccgcucaucgcccacuauuaccucaccacucuggaugaggcugaugaggcaggcaagcggauuuuugguccccggguggggaacgagcugugcgaggu

SEQ ID NO: 793 - RNA, 24 nt, Homo Sapiens
ugaggcugaugaggcaggcaagcg

SEQ ID NO: 794 - RNA, 23 nt, Homo Sapiens
aggcaggaugaggcagaagcaag

SEQ ID NO: 795 - RNA, 22 nt, Homo Sapiens
aggcugaugaagggcuggagcg

SEQ ID NO: 796 - RNA, 21 nt, Homo Sapiens
aggcacauggcggcaggcaag

SEQ ID NO: 797 - RNA, 23 nt, Homo Sapiens
aggcucagagcgcgcaggcaagc

SEQ ID NO: 798 - RNA, 20 nt, Homo Sapiens
gaggagugaggaggcaggca

SEQ ID NO: 799 - RNA, 19 nt, Homo Sapiens
gaggccgagcugaggcagg

SEQ ID NO: 800 - RNA, 16 nt, Homo Sapiens
gaggcugaggcaggca

SEQ ID NO: 801 - RNA, 20 nt, Homo Sapiens
gaggcagaaguggcaggcaa

SEQ ID NO: 802 - RNA, 17 nt, Homo Sapiens
gaggcugaggcaggaaa

SEQ ID NO: 803 - RNA, 20 nt, Homo Sapiens
gaggcagggaggcaggcaag

SEQ ID NO: 804 - RNA, 22 nt, Homo Sapiens
gaggaggugcgggaggcaagcg

SEQ ID NO: 805 - RNA, 20 nt, Homo Sapiens
gcugaugagggaagggaagc

SEQ ID NO: 806 - RNA, 19 nt, Homo Sapiens
gcagcugaggcagggcaag

SEQ ID NO: 807 - RNA, 19 nt, Homo Sapiens
ggcggaggaggcaggccag

SEQ ID NO: 808 - RNA, 22 nt, Homo Sapiens
ugauggcugaugacccagggaa

SEQ ID NO: 809 - RNA, 24 nt, Homo Sapiens
ugaggcugagugacccaguagcaa

SEQ ID NO: 810 - RNA, 19 nt, Homo Sapiens
ugagccagaggaggcaggc

SEQ ID NO: 811 - RNA, 18 nt, Homo Sapiens
ugagccugagaggcaggc

SEQ ID NO: 812 - RNA, 17 nt, Homo Sapiens
ugaggaugaggcagaca

SEQ ID NO: 813 - RNA, 19 nt, Homo Sapiens
ugaggccaagaggcaggca

SEQ ID NO: 814 - RNA, 21 nt, Homo Sapiens
ugaggcacaccaggcaggcaa

SEQ ID NO: 815 - RNA, 18 nt, Homo Sapiens
ugaggcugaggcaggaaa

SEQ ID NO: 816 - RNA, 22 nt, Homo Sapiens
ugaggcaggggaggcaggcuag

SEQ ID NO: 817 - RNA, 20 nt, Homo Sapiens
ugaggcugaugccagguaag

SEQ ID NO: 818 - RNA, 91 nt, Homo Sapiens
aggaaaaacuuauggcauguauagugagguuaaggacuugcaugucccucgcgaugguuuccuuccccuuauucuuacugcucaguguccu

SEQ ID NO: 819 - RNA, 24 nt, Homo Sapiens
uggcauguauagugagguuaagga

SEQ ID NO: 820 - RNA, 20 nt, Homo Sapiens
augaauccagagagguuaag

SEQ ID NO: 821 - RNA, 19 nt, Homo Sapiens
auguauaguaaguguugag

SEQ ID NO: 822 - RNA, 20 nt, Homo Sapiens
cauuugaagugagguuaggg

SEQ ID NO: 823 - RNA, 20 nt, Homo Sapiens
cauguauagagaauaaagga

SEQ ID NO: 824 - RNA, 20 nt, Homo Sapiens
gcuuuuauaaaugagguuaa

SEQ ID NO: 825 - RNA, 23 nt, Homo Sapiens
gcauggcuagugagguauauagg

SEQ ID NO: 826 - RNA, 19 nt, Homo Sapiens
gcauguauauuauuuuaag

SEQ ID NO: 827 - RNA, 21 nt, Homo Sapiens
gcuuguagaugagguuaaaga

SEQ ID NO: 828 - RNA, 25 nt, Homo Sapiens
ggcuagguauagugaguguucugga

SEQ ID NO: 829 - RNA, 23 nt, Homo Sapiens
ggcaaauucuuuagugagguaag

SEQ ID NO: 830 - RNA, 24 nt, Homo Sapiens
uggcauguagggagggugguucag

SEQ ID NO: 831 - RNA, 19 nt, Homo Sapiens
ugacuuauauagugaguuu

SEQ ID NO: 832 - RNA, 16 nt, Homo Sapiens
uggcaagagugagguu

SEQ ID NO: 833 - RNA, 18 nt, Homo Sapiens
uggcuagaaugagguuaa

SEQ ID NO: 834 - RNA, 21 nt, Homo Sapiens
ugggagauaagugguuaagga

SEQ ID NO: 835 - RNA, 80 nt, Homo Sapiens
aggaaaaugucuguugaugcugggccccaggcagcaccgugagagcugcaacgggcucacauuugccccuaguuuuuccu

SEQ ID NO: 836 - RNA, 24 nt, Homo Sapiens
ugucuguugaugcugggccccagg

SEQ ID NO: 837 - RNA, 20 nt, Homo Sapiens
guuugucuggggcugggccc

SEQ ID NO: 838 - RNA, 20 nt, Homo Sapiens
gucuguuggaagcugggccc

SEQ ID NO: 839 - RNA, 20 nt, Homo Sapiens
ucuuuuuguuaggccccagg

SEQ ID NO: 840 - RNA, 20 nt, Homo Sapiens
ugucugccuugugcugggcc

SEQ ID NO: 841 - RNA, 20 nt, Homo Sapiens
uguugguugauugcugggcc

SEQ ID NO: 842 - RNA, 23 nt, Homo Sapiens
ugucuguuggugugagcucgagg

SEQ ID NO: 843 - RNA, 19 nt, Homo Sapiens
ugcugaugcuggccucugg

SEQ ID NO: 844 - RNA, 19 nt, Homo Sapiens
uguugaugcuggccucugg

SEQ ID NO: 845 - RNA, 65 nt, Homo Sapiens
aggacaugugggguuucuugcucacccccacucuugugggacgcggccugugcccugauuuuccu

SEQ ID NO: 846 - RNA, 24 nt, Homo Sapiens
ugugggguuucuugcucaccccca

SEQ ID NO: 847 - RNA, 18 nt, Homo Sapiens
ggggcuucgcucaccccc

SEQ ID NO: 848 - RNA, 19 nt, Homo Sapiens
ggguuucuuccuucucacc

SEQ ID NO: 849 - RNA, 15 nt, Homo Sapiens
ggguuucuuccccca

SEQ ID NO: 850 - RNA, 21 nt, Homo Sapiens
gugaggguuucuuaucucccc

SEQ ID NO: 851 - RNA, 20 nt, Homo Sapiens
gugggguuucucggcugacc

SEQ ID NO: 852 - RNA, 21 nt, Homo Sapiens
ugggaucuucuugcuccuccc

SEQ ID NO: 853 - RNA, 19 nt, Homo Sapiens
ugggguuucuuccugagcc

SEQ ID NO: 854 - RNA, 20 nt, Homo Sapiens
ugugggguuuggucuucuca

SEQ ID NO: 855 - RNA, 21 nt, Homo Sapiens
ugugggugacucugcucaccc

SEQ ID NO: 856 - RNA, 25 nt, Homo Sapiens
ugugggguucauuggugcaucccca

SEQ ID NO: 857 - RNA, 22 nt, Homo Sapiens
ugugggguuuguuuucgacccc

SEQ ID NO: 858 - RNA, 20 nt, Homo Sapiens
ugucgugucccuugcucacc

SEQ ID NO: 859 - RNA, 20 nt, Homo Sapiens
uguggucuugcucacacaca

SEQ ID NO: 860 - RNA, 23 nt, Homo Sapiens
uguggccuucaggcucaccccca

SEQ ID NO: 861 - RNA, 24 nt, Homo Sapiens
uguggggugucaacuucaccccca

SEQ ID NO: 862 - RNA, 129 nt, Homo Sapiens
aggcugacacucucaaaggucuucucggauggaagucuccggcuccagucgucuguccacuaagcgagaggcgaguugcgagggaggcugcgggggcgggcggacguauguugagacccuaugcagccu

SEQ ID NO: 863 - RNA, 24 nt, Homo Sapiens
uggaagucuccggcuccagucguc

SEQ ID NO: 864 - RNA, 19 nt, Homo Sapiens
aguccuccggcucccgccg

SEQ ID NO: 865 - RNA, 20 nt, Homo Sapiens
ggaagucucuccggcgucag

SEQ ID NO: 866 - RNA, 22 nt, Homo Sapiens
ggaacucaaccgacuccagucg

SEQ ID NO: 867 - RNA, 19 nt, Homo Sapiens
ggaagucuccuagcucagu

SEQ ID NO: 868 - RNA, 20 nt, Homo Sapiens
ggaagucuccuucuacccag

SEQ ID NO: 869 - RNA, 17 nt, Homo Sapiens
ggaagcggcuccagcgu

SEQ ID NO: 870 - RNA, 20 nt, Homo Sapiens
ggaagucucccucacuuguc

SEQ ID NO: 871 - RNA, 24 nt, Homo Sapiens
uggaagucuuuccccucugcaguc

SEQ ID NO: 872 - RNA, 19 nt, Homo Sapiens
uggaagucuaccguccguc

SEQ ID NO: 873 - RNA, 16 nt, Homo Sapiens
uggaagucucauccag

SEQ ID NO: 874 - RNA, 19 nt, Homo Sapiens
uggaagucucagaucccgu

SEQ ID NO: 875 - RNA, 20 nt, Homo Sapiens
uggaagucucgggcugcagu

SEQ ID NO: 876 - RNA, 130 nt, Homo Sapiens
agggacgggguuucuccauguuggucaggcuggucucgggcucccggcacuuuggggggccggggcgggcggaucgccugaggucgggaguuugagaccggccuggccggcauggcgaaaccccgucucu

SEQ ID NO: 877 - RNA, 24 nt, Homo Sapiens
ucgccugaggucgggaguuugaga

SEQ ID NO: 878 - RNA, 21 nt, Homo Sapiens
ccugaggucagggccuugaga

SEQ ID NO: 879 - RNA, 19 nt, Homo Sapiens
cgccuuggcugggaguuug

SEQ ID NO: 880 - RNA, 22 nt, Homo Sapiens
cugaggucggaaccuuccgaga

SEQ ID NO: 881 - RNA, 20 nt, Homo Sapiens
cugaggucaggaguuugaga

SEQ ID NO: 882 - RNA, 20 nt, Homo Sapiens
gccugaggucagaggauuug

SEQ ID NO: 883 - RNA, 23 nt, Homo Sapiens
gccuggggacgggaguuuggaga

SEQ ID NO: 884 - RNA, 22 nt, Homo Sapiens
gccugaggucaggaguuugaga

SEQ ID NO: 885 - RNA, 22 nt, Homo Sapiens
gcuugagcucaggaguuugaga

SEQ ID NO: 886 - RNA, 22 nt, Homo Sapiens
ucgcugaugguuucgggaguuu

SEQ ID NO: 887 - RNA, 19 nt, Homo Sapiens
ucaccugaggucagcaguu

SEQ ID NO: 888 - RNA, 22 nt, Homo Sapiens
ucaccugaggucaggaguuuga

SEQ ID NO: 889 - RNA, 23 nt, Homo Sapiens
ucgcuugagcccaggaguuugag

SEQ ID NO: 890 - RNA, 22 nt, Homo Sapiens
ucggcgaggucgggaaggugag

SEQ ID NO: 891 - RNA, 24 nt, Homo Sapiens
ucacccgacgucgggaguucaaga

SEQ ID NO: 892 - RNA, 24 nt, Homo Sapiens
ucaccugaggucaggaguucgaga

SEQ ID NO: 893 - RNA, 24 nt, Homo Sapiens
ucaccugaggucaggaguuugaga

SEQ ID NO: 894 - RNA, 24 nt, Homo Sapiens
ucaccugagguccgggguuugaga

SEQ ID NO: 895 - RNA, 24 nt, Homo Sapiens
ucaccugaggucgggaguucgaga

SEQ ID NO: 896 - RNA, 24 nt, Homo Sapiens
ucaccugaggucgggaguuugaga

SEQ ID NO: 897 - RNA, 24 nt, Homo Sapiens
ucaccugaggucuggaguucgaga

SEQ ID NO: 898 - RNA, 24 nt, Homo Sapiens
ucacuugaggucaggaguuugaga

SEQ ID NO: 899 - RNA, 24 nt, Homo Sapiens
ucacuugaggucgggaguucgaga

SEQ ID NO: 900 - RNA, 24 nt, Homo Sapiens
ucacuugauguuagcaguuugaga

SEQ ID NO: 901 - RNA, 23 nt, Homo Sapiens
ucccuugggcucagaguuugaga

SEQ ID NO: 902 - RNA, 24 nt, Homo Sapiens
ucgccucaggucaggaguuugaga

SEQ ID NO: 903 - RNA, 24 nt, Homo Sapiens
ucgccugagcccaggaguuugaga

SEQ ID NO: 904 - RNA, 24 nt, Homo Sapiens
ucgccugaggucaggaguuugaga

SEQ ID NO: 905 - RNA, 67 nt, Homo Sapiens
agggaggcuggagguuguggugggucacaguguugcugacaccucuggccuccagcccugcaucccu

SEQ ID NO: 906 - RNA, 24 nt, Homo Sapiens
ugacaccucuggccuccagcccug

SEQ ID NO: 907 - RNA, 20 nt, Homo Sapiens
acaccuuggccuccaggccu

SEQ ID NO: 908 - RNA, 19 nt, Homo Sapiens
caccacugcacuccagccc

SEQ ID NO: 909 - RNA, 19 nt, Homo Sapiens
caccacuggccuccugccc

SEQ ID NO: 910 - RNA, 19 nt, Homo Sapiens
cacccuucgccuccagccc

SEQ ID NO: 911 - RNA, 20 nt, Homo Sapiens
ccucuuccccuccagcccug

SEQ ID NO: 912 - RNA, 23 nt, Homo Sapiens
gacaccgcuggccuccagucccu

SEQ ID NO: 913 - RNA, 22 nt, Homo Sapiens
gacaccccaggcuccagcccug

SEQ ID NO: 914 - RNA, 24 nt, Homo Sapiens
ugacacccucuguccccagcccug

SEQ ID NO: 915 - RNA, 21 nt, Homo Sapiens
ugagaccuggccuccaugccc

SEQ ID NO: 916 - RNA, 25 nt, Homo Sapiens
ugacaccucuggccaccaugcacug

SEQ ID NO: 917 - RNA, 19 nt, Homo Sapiens
ugucaccucugggcccagc

SEQ ID NO: 918 - RNA, 20 nt, Homo Sapiens
ugacccccuagcuccagccc

SEQ ID NO: 919 - RNA, 74 nt, Homo Sapiens
agggcggccggggagcaccugguuuuauuuccgugcagugaggggauaucauccuggugcccucgucuugguuu

SEQ ID NO: 920 - RNA, 24 nt, Homo Sapiens
aucauccuggugcccucgucuugg

SEQ ID NO: 921 - RNA, 21 nt, Homo Sapiens
aucauccugcauuccucucuu

SEQ ID NO: 922 - RNA, 22 nt, Homo Sapiens
augacccuggugccuguccugg

SEQ ID NO: 923 - RNA, 21 nt, Homo Sapiens
cauccuggucccauuaucaug

SEQ ID NO: 924 - RNA, 22 nt, Homo Sapiens
cauccugguggccuggccuggg

SEQ ID NO: 925 - RNA, 19 nt, Homo Sapiens
ccuggugccucucaggucu

SEQ ID NO: 926 - RNA, 19 nt, Homo Sapiens
ccuggugccuggugcuugg

SEQ ID NO: 927 - RNA, 20 nt, Homo Sapiens
ccuggugcccugguacaugg

SEQ ID NO: 928 - RNA, 20 nt, Homo Sapiens
ccuggugccugugucucugg

SEQ ID NO: 929 - RNA, 19 nt, Homo Sapiens
ccuggugcccggguagugg

SEQ ID NO: 930 - RNA, 19 nt, Homo Sapiens
ucagccuuggccucgucuu

SEQ ID NO: 931 - RNA, 22 nt, Homo Sapiens
ucguccuggugcucuccuccug

SEQ ID NO: 932 - RNA, 20 nt, Homo Sapiens
ucauccugggccucuccugg

SEQ ID NO: 933 - RNA, 23 nt, Homo Sapiens
uccgugugucccucucgucuugg

SEQ ID NO: 934 - RNA, 23 nt, Homo Sapiens
uccuggugccucucaaguccugg

SEQ ID NO: 935 - RNA, 23 nt, Homo Sapiens
uccuggugccuuggccguucuug

SEQ ID NO: 936 - RNA, 24 nt, Homo Sapiens
uccuggugccuuggccguuccuug

SEQ ID NO: 937 - RNA, 18 nt, Homo Sapiens
uccuggugcccuuucuug

SEQ ID NO: 938 - RNA, 74 nt, Homo Sapiens
agggggcacaccacaucaaaaugagggguguguugcuguugcgaaauuaaaaccaaucguuguguuuguccccu

SEQ ID NO: 939 - RNA, 24 nt, Homo Sapiens
aaaccaaucguuguguuugucccc

SEQ ID NO: 940 - RNA, 20 nt, Homo Sapiens
aaacacaaguuguguuuuuc

SEQ ID NO: 941 - RNA, 19 nt, Homo Sapiens
aaacaauauaguuguguuu

SEQ ID NO: 942 - RNA, 24 nt, Homo Sapiens
aaaccaaacucuaauuguguuugu

SEQ ID NO: 943 - RNA, 28 nt, Homo Sapiens
aaaccaaucuacagauuguuucuugucc

SEQ ID NO: 944 - RNA, 23 nt, Homo Sapiens
aaaccaauuuuaaauguguuugu

SEQ ID NO: 945 - RNA, 20 nt, Homo Sapiens
aaaacaauccuuuguguuug

SEQ ID NO: 946 - RNA, 19 nt, Homo Sapiens
aaucuaauauuuguguuug

SEQ ID NO: 947 - RNA, 24 nt, Homo Sapiens
acccauagcuugguuguuuguccc

SEQ ID NO: 948 - RNA, 21 nt, Homo Sapiens
acccuugguuguguuuugucc

SEQ ID NO: 949 - RNA, 19 nt, Homo Sapiens
accaguucuguuugucccc

SEQ ID NO: 950 - RNA, 17 nt, Homo Sapiens
caacguuguguuucccc

SEQ ID NO: 951 - RNA, 20 nt, Homo Sapiens
caaucguuaauuuugucccc

SEQ ID NO: 952 - RNA, 60 nt, Homo Sapiens
aggggggggcuccaaauaguguuggccuuuaaauugcugggaacggggaggcccaacccu

SEQ ID NO: 953 - RNA, 23 nt, Homo Sapiens
ugggaacggggaggcccaacccu

SEQ ID NO: 954 - RNA, 18 nt, Homo Sapiens
gaaguggaggcccagccc

SEQ ID NO: 955 - RNA, 19 nt, Homo Sapiens
gagcgaggaccccaacccu

SEQ ID NO: 956 - RNA, 24 nt, Homo Sapiens
ggaaagggaaacaaggcccaaccc

SEQ ID NO: 957 - RNA, 25 nt, Homo Sapiens
gggauggacggggaggccuaggccu

SEQ ID NO: 958 - RNA, 20 nt, Homo Sapiens
gggaagguccggggaggccc

SEQ ID NO: 959 - RNA, 20 nt, Homo Sapiens
gggagccgggggaggccgaa

SEQ ID NO: 960 - RNA, 20 nt, Homo Sapiens
gggacagggcugaggcccaa

SEQ ID NO: 961 - RNA, 20 nt, Homo Sapiens
gggaaggaggcccagaaccu

SEQ ID NO: 962 - RNA, 19 nt, Homo Sapiens
gggaagggaggcccagccc

SEQ ID NO: 963 - RNA, 19 nt, Homo Sapiens
gggaaggaggcccaucucu

SEQ ID NO: 964 - RNA, 21 nt, Homo Sapiens
uggguaaagggggaggccaaa

SEQ ID NO: 965 - RNA, 19 nt, Homo Sapiens
uggguccgggggaggccca

SEQ ID NO: 966 - RNA, 22 nt, Homo Sapiens
ugggaggggaggccacgagccu

SEQ ID NO: 967 - RNA, 16 nt, Homo Sapiens
ugggaaggaggcccaa

SEQ ID NO: 968 - RNA, 19 nt, Homo Sapiens
ugagaaguaggcccaaccc

SEQ ID NO: 969 - RNA, 20 nt, Homo Sapiens
ugggacgcagagcccaaccc

SEQ ID NO: 970 - RNA, 20 nt, Homo Sapiens
ugggagccgggcccaacccu

SEQ ID NO: 971 - RNA, 83 nt, Homo Sapiens
agucucugaccagccugaacgugucuuaugucacuuguuuggaaaugaugugauugaagauuucagagaggucauuggaggcu

SEQ ID NO: 972 - RNA, 24 nt, Homo Sapiens
ugauugaagauuucagagagguca

SEQ ID NO: 973 - RNA, 21 nt, Homo Sapiens
agccuuggcaaagugucuuau

SEQ ID NO: 974 - RNA, 20 nt, Homo Sapiens
agcaggauaggugucuuaug

SEQ ID NO: 975 - RNA, 23 nt, Homo Sapiens
agccuacgggcugucuuauguca

SEQ ID NO: 976 - RNA, 21 nt, Homo Sapiens
agccugaacgugcugaguuac

SEQ ID NO: 977 - RNA, 22 nt, Homo Sapiens
auugaagauuuuaauagaguca

SEQ ID NO: 978 - RNA, 20 nt, Homo Sapiens
auucauuauuucagaguggu

SEQ ID NO: 979 - RNA, 21 nt, Homo Sapiens
auugaagauguaaguagguca

SEQ ID NO: 980 - RNA, 25 nt, Homo Sapiens
cagccugaaauguguggccuguguc

SEQ ID NO: 981 - RNA, 19 nt, Homo Sapiens
cacccugcaugugucuuau

SEQ ID NO: 982 - RNA, 22 nt, Homo Sapiens
cagacugaacgugcugaguuac

SEQ ID NO: 983 - RNA, 22 nt, Homo Sapiens
cuguaacgugucucauuguuac

SEQ ID NO: 984 - RNA, 18 nt, Homo Sapiens
gaagauuucuagaguuca

SEQ ID NO: 985 - RNA, 21 nt, Homo Sapiens
gauacaugauuucagaugagg

SEQ ID NO: 986 - RNA, 19 nt, Homo Sapiens
gaauguagguuucagagag

SEQ ID NO: 987 - RNA, 21 nt, Homo Sapiens
gccuguuugaugugucuuaug

SEQ ID NO: 988 - RNA, 20 nt, Homo Sapiens
uguaguuaacagagagguca

SEQ ID NO: 989 - RNA, 23 nt, Homo Sapiens
ugacugagaaagauuucacgaga

SEQ ID NO: 990 - RNA, 22 nt, Homo Sapiens
ugacugaaaaguaucagagagg

SEQ ID NO: 991 - RNA, 23 nt, Homo Sapiens
ugaaucacaauuucagaguaggu

SEQ ID NO: 992 - RNA, 17 nt, Homo Sapiens
ugaucgaauuucagaga

SEQ ID NO: 993 - RNA, 19 nt, Homo Sapiens
uguuugagauucagagagg

SEQ ID NO: 994 - RNA, 22 nt, Homo Sapiens
uuguagauuucagauguagguc

SEQ ID NO: 995 - RNA, 17 nt, Homo Sapiens
uugcaguucagagaggu

SEQ ID NO: 996 - RNA, 20 nt, Homo Sapiens
uugcagugacagagagguca

SEQ ID NO: 997 - RNA, 73 nt, Homo Sapiens
agugaggggcaggaugaaaucaucuaggguagguauuuagagggagggcgccgugcaaaauaaaauccucacu

SEQ ID NO: 998 - RNA, 24 nt, Homo Sapiens
aggggcaggaugaaaucaucuagg

SEQ ID NO: 999 - RNA, 24 nt, Homo Sapiens
aggggcaggggauaagaauucauc

SEQ ID NO: 1000 - RNA, 19 nt, Homo Sapiens
aggggcagggaggaaaaca

SEQ ID NO: 1001 - RNA, 26 nt, Homo Sapiens
aggggcaggugaggaaagcagcuggg

SEQ ID NO: 1002 - RNA, 26 nt, Homo Sapiens
aggcggaggggggaaaucaucugagg

SEQ ID NO: 1003 - RNA, 23 nt, Homo Sapiens
aggggcaaaaagugaaucaucua

SEQ ID NO: 1004 - RNA, 19 nt, Homo Sapiens
aggggcaggaaaaaagcau

SEQ ID NO: 1005 - RNA, 19 nt, Homo Sapiens
aggggcaggaaccucaucu

SEQ ID NO: 1006 - RNA, 20 nt, Homo Sapiens
aggggcagggaauucaccua

SEQ ID NO: 1007 - RNA, 23 nt, Homo Sapiens
agagucaggaugaaaguauguag

SEQ ID NO: 1008 - RNA, 19 nt, Homo Sapiens
caggauggagaaaucaucu

SEQ ID NO: 1009 - RNA, 21 nt, Homo Sapiens
caggaagaaucaucaucuagg

SEQ ID NO: 1010 - RNA, 21 nt, Homo Sapiens
caggaugaagucacguccagg

SEQ ID NO: 1011 - RNA, 19 nt, Homo Sapiens
caggaugaaauaagccagg

SEQ ID NO: 1012 - RNA, 20 nt, Homo Sapiens
gcugguucauaucaucuagg

SEQ ID NO: 1013 - RNA, 18 nt, Homo Sapiens
ggcugguuaaaucaucua

SEQ ID NO: 1014 - RNA, 19 nt, Homo Sapiens
ggcaggaugcaucacuagg

SEQ ID NO: 1015 - RNA, 22 nt, Homo Sapiens
ggacuggaugaaaugaucuugg

SEQ ID NO: 1016 - RNA, 19 nt, Homo Sapiens
ggggcaggaaaaacucuag

SEQ ID NO: 1017 - RNA, 79 nt, Homo Sapiens
aguggacaaugucauguuuggagaaagauaacaacacaaauaauguaaccuuuccuuaaaaggcagaacucaauccauu

SEQ ID NO: 1018 - RNA, 24 nt, Homo Sapiens
ugucauguuuggagaaagauaaca

SEQ ID NO: 1019 - RNA, 20 nt, Homo Sapiens
auguucucuggagaaagaua

SEQ ID NO: 1020 - RNA, 18 nt, Homo Sapiens
auguuggauaaagauaac

SEQ ID NO: 1021 - RNA, 19 nt, Homo Sapiens
caaguuugaaggagaaaga

SEQ ID NO: 1022 - RNA, 20 nt, Homo Sapiens
caucuuuggagaacacauaa

SEQ ID NO: 1023 - RNA, 20 nt, Homo Sapiens
caggcuuggagaaacaaaca

SEQ ID NO: 1024 - RNA, 20 nt, Homo Sapiens
gucagugccuuuggagaaag

SEQ ID NO: 1025 - RNA, 25 nt, Homo Sapiens
ucauuuuaccugaacaaagauaaca

SEQ ID NO: 1026 - RNA, 24 nt, Homo Sapiens
ucagguuuuggagaaaaacauaac

SEQ ID NO: 1027 - RNA, 22 nt, Homo Sapiens
ucaagauugagaaagaucaaca

SEQ ID NO: 1028 - RNA, 24 nt, Homo Sapiens
ugucauguuaaacaggagaaagau

SEQ ID NO: 1029 - RNA, 17 nt, Homo Sapiens
ugucauguuacaaugau

SEQ ID NO: 1030 - RNA, 20 nt, Homo Sapiens
ugucauguuaggaaaaacau

SEQ ID NO: 1031 - RNA, 20 nt, Homo Sapiens
ugucauguuaggaugaacau

SEQ ID NO: 1032 - RNA, 20 nt, Homo Sapiens
ugccaugcuggagaaagcua

SEQ ID NO: 1033 - RNA, 22 nt, Homo Sapiens
ugucaaauuuggagaaacaaaa

SEQ ID NO: 1034 - RNA, 22 nt, Homo Sapiens
ugucagcccuguagaaagauaa

SEQ ID NO: 1035 - RNA, 24 nt, Homo Sapiens
ugucauguuaggaaagaauuaaca

SEQ ID NO: 1036 - RNA, 19 nt, Homo Sapiens
uguuucaggugaaagauaa

SEQ ID NO: 1037 - RNA, 67 nt, Homo Sapiens
aguugaucagauuucaaggucuggggaguauauccacuguguacugggucuugagcucuagagagcu

SEQ ID NO: 1038 - RNA, 24 nt, Homo Sapiens
ucagauuucaaggucuggggagua

SEQ ID NO: 1039 - RNA, 24 nt, Homo Sapiens
acugcccugaucugggucuucagc

SEQ ID NO: 1040 - RNA, 24 nt, Homo Sapiens
agauuuccagaacaauggggagua

SEQ ID NO: 1041 - RNA, 19 nt, Homo Sapiens
auuugccaaggucuggaga

SEQ ID NO: 1042 - RNA, 20 nt, Homo Sapiens
cagcauuucaaggccaaggg

SEQ ID NO: 1043 - RNA, 20 nt, Homo Sapiens
cagcucucagugucugggga

SEQ ID NO: 1044 - RNA, 21 nt, Homo Sapiens
cagauuucagggagugggagu

SEQ ID NO: 1045 - RNA, 21 nt, Homo Sapiens
cucuguacugggaacugugcu

SEQ ID NO: 1046 - RNA, 22 nt, Homo Sapiens
cugugagcuggcgcuugagcuc

SEQ ID NO: 1047 - RNA, 21 nt, Homo Sapiens
cugugcccugucuugagcucu

SEQ ID NO: 1048 - RNA, 21 nt, Homo Sapiens
gauugagaggccucuggggag

SEQ ID NO: 1049 - RNA, 21 nt, Homo Sapiens
gauugcaaggucugaagggga

SEQ ID NO: 1050 - RNA, 19 nt, Homo Sapiens
gaugucagggucugggcag

SEQ ID NO: 1051 - RNA, 17 nt, Homo Sapiens
gauuuaaauggggagua

SEQ ID NO: 1052 - RNA, 19 nt, Homo Sapiens
guguacacucggucuugag

SEQ ID NO: 1053 - RNA, 21 nt, Homo Sapiens
gugucauugaccuugagcucu

SEQ ID NO: 1054 - RNA, 24 nt, Homo Sapiens
ucaggaucccuaggucugggagag

SEQ ID NO: 1055 - RNA, 28 nt, Homo Sapiens
ucagaauggcaagagcugcuggggagua

SEQ ID NO: 1056 - RNA, 20 nt, Homo Sapiens
ucaaacugcagggucugggg

SEQ ID NO: 1057 - RNA, 20 nt, Homo Sapiens
ucagauuucaaagucgaggg

SEQ ID NO: 1058 - RNA, 20 nt, Homo Sapiens
ucagauuucaggauuaggga

SEQ ID NO: 1059 - RNA, 18 nt, Homo Sapiens
uguggacugcuugagcuc

SEQ ID NO: 1060 - RNA, 18 nt, Homo Sapiens
uguguacuguugagaucu

SEQ ID NO: 1061 - RNA, 61 nt, Homo Sapiens
auagaaguauacugagagucuaaaauacauucuaguagugcaugucuuggugugcuuuugu

SEQ ID NO: 1062 - RNA, 24 nt, Homo Sapiens
uagaaguauacugagagucuaaaa

SEQ ID NO: 1063 - RNA, 22 nt, Homo Sapiens
aacuaucagggagagucuacaa

SEQ ID NO: 1064 - RNA, 20 nt, Homo Sapiens
aaguauacuugcuaguacua

SEQ ID NO: 1065 - RNA, 19 nt, Homo Sapiens
aaguguaauagagucuaaa

SEQ ID NO: 1066 - RNA, 21 nt, Homo Sapiens
agaauguauacugaucuuaaa

SEQ ID NO: 1067 - RNA, 23 nt, Homo Sapiens
agaaauauacugagaugugcaaa

SEQ ID NO: 1068 - RNA, 19 nt, Homo Sapiens
agauaucuacugagagccu

SEQ ID NO: 1069 - RNA, 18 nt, Homo Sapiens
agcagaugcugagagucu

SEQ ID NO: 1070 - RNA, 21 nt, Homo Sapiens
agaaauguacaagagucuaaa

SEQ ID NO: 1071 - RNA, 19 nt, Homo Sapiens
aguauucuaaagagucuaa

SEQ ID NO: 1072 - RNA, 19 nt, Homo Sapiens
aguauacugaaacaauaaa

SEQ ID NO: 1073 - RNA, 18 nt, Homo Sapiens
aguauacugcgauuuaaa

SEQ ID NO: 1074 - RNA, 21 nt, Homo Sapiens
gaaguauaccagaaggcaaaa

SEQ ID NO: 1075 - RNA, 24 nt, Homo Sapiens
uauaagugauaagaaagucuaaaa

SEQ ID NO: 1076 - RNA, 22 nt, Homo Sapiens
uagaaguauaaaugagguuuaa

SEQ ID NO: 1077 - RNA, 25 nt, Homo Sapiens
uaaaagcauauuugcaagucuaaaa

SEQ ID NO: 1078 - RNA, 87 nt, Homo Sapiens
auauauguuuucuuuuuaagcuagcuaaagaaaauacucuugaucgggguuaguucuuaaagcaaaaaacagaagaaaaguauguau

SEQ ID NO: 1079 - RNA, 24 nt, Homo Sapiens
uaagcuagcuaaagaaaauacucu

SEQ ID NO: 1080 - RNA, 24 nt, Homo Sapiens
aagcucugccaaacaaaauacucu

SEQ ID NO: 1081 - RNA, 17 nt, Homo Sapiens
aaacuagaaagaaaaua

SEQ ID NO: 1082 - RNA, 19 nt, Homo Sapiens
aaguagagaaagaaaauac

SEQ ID NO: 1083 - RNA, 20 nt, Homo Sapiens
agcuaacaauuaagaaaaua

SEQ ID NO: 1084 - RNA, 18 nt, Homo Sapiens
cuggcuuagaaaauacuc

SEQ ID NO: 1085 - RNA, 20 nt, Homo Sapiens
cuugcuaaagaaaaucuucu

SEQ ID NO: 1086 - RNA, 20 nt, Homo Sapiens
gcuauacuaaagaaaacucu

SEQ ID NO: 1087 - RNA, 20 nt, Homo Sapiens
uaacuggcuggaaagaaaau

SEQ ID NO: 1088 - RNA, 28 nt, Homo Sapiens
uaaucaagcuaauacuaaaaaauacucu

SEQ ID NO: 1089 - RNA, 24 nt, Homo Sapiens
uaaguuaacaaagaaaauuaaucu

SEQ ID NO: 1090 - RNA, 17 nt, Homo Sapiens
uaagcacuaaagaaaau

SEQ ID NO: 1091 - RNA, 21 nt, Homo Sapiens
uagcuaaagugaaaaaacacu

SEQ ID NO: 1092 - RNA, 20 nt, Homo Sapiens
uagguaaagaaaaauacacu

SEQ ID NO: 1093 - RNA, 19 nt, Homo Sapiens
uagccaaagaaaaauacuc

SEQ ID NO: 1094 - RNA, 18 nt, Homo Sapiens
uaguaaagaaaauuaucu

SEQ ID NO: 1095 - RNA, 64 nt, Homo Sapiens
auauggucaugugaaucaaauuugauguauaaaguacucacacaaguugucucaaagaugauau

SEQ ID NO: 1096 - RNA, 24 nt, Homo Sapiens
uauggucaugugaaucaaauuuga

SEQ ID NO: 1097 - RNA, 19 nt, Homo Sapiens
augggcagucaaucaaauu

SEQ ID NO: 1098 - RNA, 20 nt, Homo Sapiens
auggucaugaaagcaaaguu

SEQ ID NO: 1099 - RNA, 20 nt, Homo Sapiens
augguuugaguucaaauuug

SEQ ID NO: 1100 - RNA, 22 nt, Homo Sapiens
caugagaaagguucaaauuuga

SEQ ID NO: 1101 - RNA, 22 nt, Homo Sapiens
uaugguaaaaugagaaucaaau

SEQ ID NO: 1102 - RNA, 21 nt, Homo Sapiens
uauggucauuggaaucuuauu

SEQ ID NO: 1103 - RNA, 19 nt, Homo Sapiens
uaugaucgugaucaaauuu

SEQ ID NO: 1104 - RNA, 20 nt, Homo Sapiens
ugguccuaugugaaucuaau

SEQ ID NO: 1105 - RNA, 25 nt, Homo Sapiens
ugguaaaugucacugacaaauuuga

SEQ ID NO: 1106 - RNA, 20 nt, Homo Sapiens
uggucauguaaaaauuaaau

SEQ ID NO: 1107 - RNA, 21 nt, Homo Sapiens
ugcucuuugaaaucaaauuug

SEQ ID NO: 1108 - RNA, 21 nt, Homo Sapiens
uggucauguauucauaauuug

SEQ ID NO: 1109 - RNA, 19 nt, Homo Sapiens
ugaucauacgaaucaaauu

SEQ ID NO: 1110 - RNA, 21 nt, Homo Sapiens
uggucaugugaguuaauucug

SEQ ID NO: 1111 - RNA, 62 nt, Homo Sapiens
auauggugugagaaauggcuguaggaaacaacacucaacgaaguuauuccaucaucccgugu

SEQ ID NO: 1112 - RNA, 24 nt, Homo Sapiens
uauggugugagaaauggcuguagg

SEQ ID NO: 1113 - RNA, 25 nt, Homo Sapiens
auggugugagagaguggggcugagg

SEQ ID NO: 1114 - RNA, 21 nt, Homo Sapiens
ggugagagagcaggcuguagg

SEQ ID NO: 1115 - RNA, 21 nt, Homo Sapiens
ggugugagaacagacuccagg

SEQ ID NO: 1116 - RNA, 19 nt, Homo Sapiens
ggugugagagcugcugagg

SEQ ID NO: 1117 - RNA, 19 nt, Homo Sapiens
ggugugugcaggcuguagg

SEQ ID NO: 1118 - RNA, 23 nt, Homo Sapiens
uaugugugugagaauuugugaag

SEQ ID NO: 1119 - RNA, 21 nt, Homo Sapiens
uauagaugugagaaacagcug

SEQ ID NO: 1120 - RNA, 19 nt, Homo Sapiens
ugagaaauggcagaauagg

SEQ ID NO: 1121 - RNA, 22 nt, Homo Sapiens
uggcugugggaagaaauggcug

SEQ ID NO: 1122 - RNA, 20 nt, Homo Sapiens
ugauguuacauauggcugua

SEQ ID NO: 1123 - RNA, 22 nt, Homo Sapiens
ugcugugagaaaaggauggagg

SEQ ID NO: 1124 - RNA, 72 nt, Homo Sapiens
aucacaagugggguguacucccccuugcauauugggaacaacaucacaagugggguguacugccucugugau

SEQ ID NO: 1125 - RNA, 24 nt, Homo Sapiens
ucacaagugggguguacugccucu

SEQ ID NO: 1126 - RNA, 20 nt, Homo Sapiens
aaguggggugaagauuccuc

SEQ ID NO: 1127 - RNA, 20 nt, Homo Sapiens
aaguggggugaagucuccuc

SEQ ID NO: 1128 - RNA, 25 nt, Homo Sapiens
acaagugggcaggugaacauggcuc

SEQ ID NO: 1129 - RNA, 24 nt, Homo Sapiens
cacaaaugaaauggaacugccucu

SEQ ID NO: 1130 - RNA, 17 nt, Homo Sapiens
cacaauuuguacugccu

SEQ ID NO: 1131 - RNA, 20 nt, Homo Sapiens
gguguacucgccaccuggca

SEQ ID NO: 1132 - RNA, 19 nt, Homo Sapiens
gguguacuccccagagcau

SEQ ID NO: 1133 - RNA, 22 nt, Homo Sapiens
ucacauuguggggugucgcugc

SEQ ID NO: 1134 - RNA, 18 nt, Homo Sapiens
ucacagggggguguacug

SEQ ID NO: 1135 - RNA, 24 nt, Homo Sapiens
uggggaugucaagaccccccuugc

SEQ ID NO: 1136 - RNA, 20 nt, Homo Sapiens
uggggauguggcccccuugc

SEQ ID NO: 1137 - RNA, 20 nt, Homo Sapiens
ugggcuuuagccucccccuu

SEQ ID NO: 1138 - RNA, 15 nt, Homo Sapiens
ugggguucccccuug

SEQ ID NO: 1139 - RNA, 18 nt, Homo Sapiens
ugggcugcacccccuugc

SEQ ID NO: 1140 - RNA, 69 nt, Homo Sapiens
aucacagcugugccaguaauaaggaugcuaacaauuaauuuuaucaaaccuaacugugacagcugugau

SEQ ID NO: 1141 - RNA, 24 nt, Homo Sapiens
ucacagcugugccaguaauaagga

SEQ ID NO: 1142 - RNA, 21 nt, Homo Sapiens
aaacauaacugugaaaaugug

SEQ ID NO: 1143 - RNA, 20 nt, Homo Sapiens
aaccuaucaucugugacagc

SEQ ID NO: 1144 - RNA, 21 nt, Homo Sapiens
acagcugugcaccuaagcagg

SEQ ID NO: 1145 - RNA, 20 nt, Homo Sapiens
acagcugugcuuuaucagga

SEQ ID NO: 1146 - RNA, 22 nt, Homo Sapiens
caauacuagcgugugacagcug

SEQ ID NO: 1147 - RNA, 20 nt, Homo Sapiens
caaaccuaacuguaguacag

SEQ ID NO: 1148 - RNA, 23 nt, Homo Sapiens
cacaucaauugugccagugauaa

SEQ ID NO: 1149 - RNA, 24 nt, Homo Sapiens
cacugcuugagagcaguaauaagg

SEQ ID NO: 1150 - RNA, 21 nt, Homo Sapiens
cagagcugugcccagcaguaa

SEQ ID NO: 1151 - RNA, 22 nt, Homo Sapiens
cacagcuguucugcauugauaa

SEQ ID NO: 1152 - RNA, 17 nt, Homo Sapiens
cacagcugugguaaaaa

SEQ ID NO: 1153 - RNA, 19 nt, Homo Sapiens
cacagcugugcggaaaagg

SEQ ID NO: 1154 - RNA, 19 nt, Homo Sapiens
gcuuuuccuguaauaagga

SEQ ID NO: 1155 - RNA, 21 nt, Homo Sapiens
ucaaaggccugugccagauaa

SEQ ID NO: 1156 - RNA, 22 nt, Homo Sapiens
ucaaagccagugagccaguaau

SEQ ID NO: 1157 - RNA, 21 nt, Homo Sapiens
ucacagcuguagcauuuauaa

SEQ ID NO: 1158 - RNA, 22 nt, Homo Sapiens
ucacagcugggcggggaguaag

SEQ ID NO: 1159 - RNA, 121 nt, Homo Sapiens
aucgucaaugaaagcccugggcugcucuccaggaugucaccauuggggguucggcucguccgguggccggggcggguuuccaccgguguggcgccuggccgcguccggggcuucgggcgau

SEQ ID NO: 1160 - RNA, 24 nt, Homo Sapiens
ugucaccauuggggguucggcucg

SEQ ID NO: 1161 - RNA, 19 nt, Homo Sapiens
accccuggggguucaguuc

SEQ ID NO: 1162 - RNA, 19 nt, Homo Sapiens
gucacaaggcuuggggguu

SEQ ID NO: 1163 - RNA, 20 nt, Homo Sapiens
ucauccauuggggucggguc

SEQ ID NO: 1164 - RNA, 20 nt, Homo Sapiens
ucaccucguggggguuccgc

SEQ ID NO: 1165 - RNA, 21 nt, Homo Sapiens
ucuccauugggguccagcccg

SEQ ID NO: 1166 - RNA, 22 nt, Homo Sapiens
ugucaccauggcuuggggcuuc

SEQ ID NO: 1167 - RNA, 21 nt, Homo Sapiens
uggccccaguuuggguucggc

SEQ ID NO: 1168 - RNA, 60 nt, Homo Sapiens
aucguggggcuugugggaaaugguggggagugccaauggccguaaauuaugugucgcgau

SEQ ID NO: 1169 - RNA, 24 nt, Homo Sapiens
uggccguaaauuaugugucgcgau

SEQ ID NO: 1170 - RNA, 18 nt, Homo Sapiens
uggcguacuuuauguguc

SEQ ID NO: 1171 - RNA, 65 nt, Homo Sapiens
augagauuugggaggggccaggggcagaaugauaugguuugacuguguccucacccaaaucucau

SEQ ID NO: 1172 - RNA, 24 nt, Homo Sapiens
ugagauuugggaggggccaggggc

SEQ ID NO: 1173 - RNA, 19 nt, Homo Sapiens
agaguauggagggccaggg

SEQ ID NO: 1174 - RNA, 19 nt, Homo Sapiens
agauuuggggggaccaggg

SEQ ID NO: 1175 - RNA, 20 nt, Homo Sapiens
agcucugggaggggacaugg

SEQ ID NO: 1176 - RNA, 21 nt, Homo Sapiens
agauuugggaagggucauggg

SEQ ID NO: 1177 - RNA, 20 nt, Homo Sapiens
agauggggaggggcgggggc

SEQ ID NO: 1178 - RNA, 21 nt, Homo Sapiens
agauuugugguugccaggggc

SEQ ID NO: 1179 - RNA, 29 nt, Homo Sapiens
gagauugguggaugaggcagggccagggg

SEQ ID NO: 1180 - RNA, 18 nt, Homo Sapiens
gagacuugggagggcagg

SEQ ID NO: 1181 - RNA, 19 nt, Homo Sapiens
gagaguggggggccagggg

SEQ ID NO: 1182 - RNA, 23 nt, Homo Sapiens
gacaugggggaggggcugggggc

SEQ ID NO: 1183 - RNA, 20 nt, Homo Sapiens
gagagugggaggggaggggc

SEQ ID NO: 1184 - RNA, 17 nt, Homo Sapiens
gauuggaggggccaggg

SEQ ID NO: 1185 - RNA, 19 nt, Homo Sapiens
gaucggggaggggcagggg

SEQ ID NO: 1186 - RNA, 25 nt, Homo Sapiens
ugagagccgcggcggggccaggggc

SEQ ID NO: 1187 - RNA, 18 nt, Homo Sapiens
ugagauuuggaggggaca

SEQ ID NO: 1188 - RNA, 19 nt, Homo Sapiens
ugacauugugaggggccag

SEQ ID NO: 1189 - RNA, 21 nt, Homo Sapiens
ugacaucagggaggggcaagg

SEQ ID NO: 1190 - RNA, 20 nt, Homo Sapiens
ugggacuugggagggcaggg

SEQ ID NO: 1191 - RNA, 21 nt, Homo Sapiens
ugggauuggaggggcccuggg

SEQ ID NO: 1192 - RNA, 23 nt, Homo Sapiens
ugagauuuggaagcugcacgggc

SEQ ID NO: 1193 - RNA, 22 nt, Homo Sapiens
ugaggcgugggaggggcggggc

SEQ ID NO: 1194 - RNA, 19 nt, Homo Sapiens
uugggaggguccagugggc

SEQ ID NO: 1195 - RNA, 19 nt, Homo Sapiens
uuugggagggggcaugggc

SEQ ID NO: 1196 - RNA, 64 nt, Homo Sapiens
augaggaacuccuacaacucaauaguaaaacaaacaaaaaccccugauuccuggagauccugau

SEQ ID NO: 1197 - RNA, 24 nt, Homo Sapiens
ugaggaacuccuacaacucaauag

SEQ ID NO: 1198 - RNA, 19 nt, Homo Sapiens
agaaacuccuacaagucaa

SEQ ID NO: 1199 - RNA, 18 nt, Homo Sapiens
aggaacuccugaccucaa

SEQ ID NO: 1200 - RNA, 18 nt, Homo Sapiens
gaaucucccaacucaaua

SEQ ID NO: 1201 - RNA, 21 nt, Homo Sapiens
gagcaacuccuacucccaaua

SEQ ID NO: 1202 - RNA, 20 nt, Homo Sapiens
ggaacuccuacccccaguag

SEQ ID NO: 1203 - RNA, 19 nt, Homo Sapiens
ugaggaacuccuccuccuc

SEQ ID NO: 1204 - RNA, 20 nt, Homo Sapiens
uguggaacuccuccccucaa

SEQ ID NO: 1205 - RNA, 23 nt, Homo Sapiens
ugaggaacuccaagaaucuagag

SEQ ID NO: 1206 - RNA, 62 nt, Homo Sapiens
augcaguauuugguuuccuguuccuguguuaauuugcuuaggauaauggccuccagcugcau

SEQ ID NO: 1207 - RNA, 24 nt, Homo Sapiens
augcaguauuugguuuccuguucc

SEQ ID NO: 1208 - RNA, 20 nt, Homo Sapiens
augcauuaugaugguuuccu

SEQ ID NO: 1209 - RNA, 24 nt, Homo Sapiens
augaaauacuaugguuuccuauuc

SEQ ID NO: 1210 - RNA, 25 nt, Homo Sapiens
augugguauuucugguuuccugauc

SEQ ID NO: 1211 - RNA, 19 nt, Homo Sapiens
augaagcacaugguuuccu

SEQ ID NO: 1212 - RNA, 16 nt, Homo Sapiens
augcaguauuuuuccu

SEQ ID NO: 1213 - RNA, 22 nt, Homo Sapiens
caguaugugggcauccuguucc

SEQ ID NO: 1214 - RNA, 22 nt, Homo Sapiens
caguauuugguuuccgauuguu

SEQ ID NO: 1215 - RNA, 19 nt, Homo Sapiens
cauuauuuuuuuuccuguu

SEQ ID NO: 1216 - RNA, 20 nt, Homo Sapiens
caguauuugguagccuuucc

SEQ ID NO: 1217 - RNA, 18 nt, Homo Sapiens
gcagucuuguuuccuguu

SEQ ID NO: 1218 - RNA, 19 nt, Homo Sapiens
gcauucuuuguuuccuguu

SEQ ID NO: 1219 - RNA, 19 nt, Homo Sapiens
ugcaauauuugguuuuccu

SEQ ID NO: 1220 - RNA, 77 nt, Homo Sapiens
auguguucgugacacggaucaaccuuuuugugcuuaucgaggagcagaaaaucguugugaaaguguugaagccacgu

SEQ ID NO: 1221 - RNA, 24 nt, Homo Sapiens
ugacacggaucaaccuuuuugugc

SEQ ID NO: 1222 - RNA, 22 nt, Homo Sapiens
gauccaaaaccuauuuuugugc

SEQ ID NO: 1223 - RNA, 24 nt, Homo Sapiens
ugacaagugacaaccuuuucaugc

SEQ ID NO: 1224 - RNA, 23 nt, Homo Sapiens
ugacacagcuacacaaccuuuuu

SEQ ID NO: 1225 - RNA, 19 nt, Homo Sapiens
ugaaacagcaaccuuuuug

SEQ ID NO: 1226 - RNA, 23 nt, Homo Sapiens
ugaccagguuaauuuuuuugugc

SEQ ID NO: 1227 - RNA, 62 nt, Homo Sapiens
auucagaguccugcaccaagccccagagaugguuuuggugggucuugguggggcccaggaau

SEQ ID NO: 1228 - RNA, 24 nt, Homo Sapiens
ucagaguccugcaccaagccccag

SEQ ID NO: 1229 - RNA, 23 nt, Homo Sapiens
agcguccugcacagaaggcccag

SEQ ID NO: 1230 - RNA, 21 nt, Homo Sapiens
agugcaacauccaagccccag

SEQ ID NO: 1231 - RNA, 19 nt, Homo Sapiens
agucugcaccaaagcccag

SEQ ID NO: 1232 - RNA, 21 nt, Homo Sapiens
cagagcuccagcccuagcucc

SEQ ID NO: 1233 - RNA, 23 nt, Homo Sapiens
cagacuuacugauccaagcccca

SEQ ID NO: 1234 - RNA, 21 nt, Homo Sapiens
cagaguccucuacuccagccc

SEQ ID NO: 1235 - RNA, 19 nt, Homo Sapiens
cagggccuguccaagcccc

SEQ ID NO: 1236 - RNA, 21 nt, Homo Sapiens
gagcuccagcucaagccccag

SEQ ID NO: 1237 - RNA, 18 nt, Homo Sapiens
gaguccugcuccacccag

SEQ ID NO: 1238 - RNA, 23 nt, Homo Sapiens
gggucuagagugggggcccagga

SEQ ID NO: 1239 - RNA, 22 nt, Homo Sapiens
gggucuugguauguugcccagg

SEQ ID NO: 1240 - RNA, 24 nt, Homo Sapiens
gggucuuggugucggggaacagga

SEQ ID NO: 1241 - RNA, 20 nt, Homo Sapiens
gggucuuggucgugggccca

SEQ ID NO: 1242 - RNA, 24 nt, Homo Sapiens
gggucucucugggcugcccaggaa

SEQ ID NO: 1243 - RNA, 16 nt, Homo Sapiens
gggucuugggccaagg

SEQ ID NO: 1244 - RNA, 18 nt, Homo Sapiens
ggucugguggggcccugg

SEQ ID NO: 1245 - RNA, 19 nt, Homo Sapiens
guccugccccaccaagccc

SEQ ID NO: 1246 - RNA, 17 nt, Homo Sapiens
gucuguggggcccggga

SEQ ID NO: 1247 - RNA, 18 nt, Homo Sapiens
ucaggagucugcaccaag

SEQ ID NO: 1248 - RNA, 21 nt, Homo Sapiens
ucagcagcauucaccaagccc

SEQ ID NO: 1249 - RNA, 23 nt, Homo Sapiens
ucagagucccagccaggcgcgag

SEQ ID NO: 1250 - RNA, 26 nt, Homo Sapiens
ucagagucuggaaucuuaagccccag

SEQ ID NO: 1251 - RNA, 21 nt, Homo Sapiens
ucagaguccgacacaagcccc

SEQ ID NO: 1252 - RNA, 21 nt, Homo Sapiens
ugggucugugguguggggccc

SEQ ID NO: 1253 - RNA, 23 nt, Homo Sapiens
ugggucuugcucuguugcccagg

SEQ ID NO: 1254 - RNA, 22 nt, Homo Sapiens
ugggucuugcucguugcccagg

SEQ ID NO: 1255 - RNA, 20 nt, Homo Sapiens
ugggccugguggggccacag

SEQ ID NO: 1256 - RNA, 19 nt, Homo Sapiens
uggcucuucuggggcccag

SEQ ID NO: 1257 - RNA, 22 nt, Homo Sapiens
ugggacuccuuggggcccagga

SEQ ID NO: 1258 - RNA, 21 nt, Homo Sapiens
ugggcuggucgagcccaggaa

SEQ ID NO: 1259 - RNA, 64 nt, Homo Sapiens
auucuuaaucuuagugaaauucugaaauacuugauaauucuuuaaaagcugucugguuaagaau

SEQ ID NO: 1260 - RNA, 22 nt, Homo Sapiens
uaaaagcugucugguuaagaau

SEQ ID NO: 1261 - RNA, 18 nt, Homo Sapiens
aagaacugcugguuaaga

SEQ ID NO: 1262 - RNA, 18 nt, Homo Sapiens
aaaaguugagguuaagaa

SEQ ID NO: 1263 - RNA, 21 nt, Homo Sapiens
aaaagcuguuaggcaaaaaau

SEQ ID NO: 1264 - RNA, 19 nt, Homo Sapiens
aaaggugauggguuaagaa

SEQ ID NO: 1265 - RNA, 20 nt, Homo Sapiens
aaagcugcaauguuaagaau

SEQ ID NO: 1266 - RNA, 17 nt, Homo Sapiens
aaggcuguguuaagaau

SEQ ID NO: 1267 - RNA, 21 nt, Homo Sapiens
aagcugucuuuguuuaaaaau

SEQ ID NO: 1268 - RNA, 23 nt, Homo Sapiens
uaaacagaggccuaguuaagaau

SEQ ID NO: 1269 - RNA, 22 nt, Homo Sapiens
uaaaaacuugugaugguuaaga

SEQ ID NO: 1270 - RNA, 19 nt, Homo Sapiens
uaaaagcugcuuuuguaag

SEQ ID NO: 1271 - RNA, 25 nt, Homo Sapiens
uaaauucuguagcucugguuaagaa

SEQ ID NO: 1272 - RNA, 24 nt, Homo Sapiens
uaaaagcugucuggcccugaagaa

SEQ ID NO: 1273 - RNA, 27 nt, Homo Sapiens
uaaaggcugucuggcuuagcucagaau

SEQ ID NO: 1274 - RNA, 21 nt, Homo Sapiens
uaaaagcugucuguugugaau

SEQ ID NO: 1275 - RNA, 19 nt, Homo Sapiens
uacaagcugucuuaagaau

SEQ ID NO: 1276 - RNA, 77 nt, Homo Sapiens
auuuguuuuuauugguguagucgcugcaguuuuaccugccaugguggugcucagguauaacauagauggaaacaagu

SEQ ID NO: 1277 - RNA, 24 nt, Homo Sapiens
uauugguguagucgcugcaguuuu

SEQ ID NO: 1278 - RNA, 20 nt, Homo Sapiens
auaggugaacugcugcaguu

SEQ ID NO: 1279 - RNA, 21 nt, Homo Sapiens
auugguguauucaaagcaguu

SEQ ID NO: 1280 - RNA, 21 nt, Homo Sapiens
auuguugaugacugcaguuuu

SEQ ID NO: 1281 - RNA, 18 nt, Homo Sapiens
ggugagucucugcaguuu

SEQ ID NO: 1282 - RNA, 19 nt, Homo Sapiens
guggucauggcugcaguuu

SEQ ID NO: 1283 - RNA, 24 nt, Homo Sapiens
uacugguguugagaagcugcaguu

SEQ ID NO: 1284 - RNA, 22 nt, Homo Sapiens
uaaugguguaguuggcuguuuu

SEQ ID NO: 1285 - RNA, 19 nt, Homo Sapiens
ugcuguagucgccuggcag

SEQ ID NO: 1286 - RNA, 22 nt, Homo Sapiens
ugguguaguccaugauaguguu

SEQ ID NO: 1287 - RNA, 19 nt, Homo Sapiens
uggccuagcagcugcaguu

SEQ ID NO: 1288 - RNA, 24 nt, Homo Sapiens
uuggcauguguucacugcaguuuu

SEQ ID NO: 1289 - RNA, 24 nt, Homo Sapiens
uugguguagggggcuguaaguuuu

SEQ ID NO: 1290 - RNA, 17 nt, Homo Sapiens
uugggggucgcugcagu

SEQ ID NO: 1291 - RNA, 20 nt, Homo Sapiens
uuuguguaacccugcaguuu

SEQ ID NO: 1292 - RNA, 21 nt, Homo Sapiens
uugguuuuauugugcaguuuu

SEQ ID NO: 1293 - RNA, 76 nt, Homo Sapiens
caaagccagcaacgacauguaccacagccgcgcgcugcagguggugcgcgcccgcaagcagaucguagcuggggug

SEQ ID NO: 1294 - RNA, 24 nt, Homo Sapiens
acgacauguaccacagccgcgcgc

SEQ ID NO: 1295 - RNA, 20 nt, Homo Sapiens
acgcgugcacacacagccgc

SEQ ID NO: 1296 - RNA, 20 nt, Homo Sapiens
cauguaccaggcacugccgc

SEQ ID NO: 1297 - RNA, 20 nt, Homo Sapiens
cacguacagccgccgcgcgc

SEQ ID NO: 1298 - RNA, 19 nt, Homo Sapiens
caugacuccagccgcgcgc

SEQ ID NO: 1299 - RNA, 20 nt, Homo Sapiens
gagauuuacuacacagccgc

SEQ ID NO: 1300 - RNA, 21 nt, Homo Sapiens
gacauguaccuaacagaagcg

SEQ ID NO: 1301 - RNA, 24 nt, Homo Sapiens
ggggcugggcccaaggcaagcaga

SEQ ID NO: 1302 - RNA, 22 nt, Homo Sapiens
ugguuuggacagcaagcagauc

SEQ ID NO: 1303 - RNA, 68 nt, Homo Sapiens
caaugggaagguugaugcucgaagugaccgaacuggggaggucaucuuuaaggacaauuuuucuucug

SEQ ID NO: 1304 - RNA, 24 nt, Homo Sapiens
ugggaagguugaugcucgaaguga

SEQ ID NO: 1305 - RNA, 19 nt, Homo Sapiens
aagauugaugcucaagaga

SEQ ID NO: 1306 - RNA, 19 nt, Homo Sapiens
gaagguugacccugauagu

SEQ ID NO: 1307 - RNA, 20 nt, Homo Sapiens
gaagguugaggccgcaguga

SEQ ID NO: 1308 - RNA, 21 nt, Homo Sapiens
ggaagcucugaugcucgagug

SEQ ID NO: 1309 - RNA, 21 nt, Homo Sapiens
gggaagguuguggacaaagug

SEQ ID NO: 1310 - RNA, 22 nt, Homo Sapiens
ugggaagguacaggaggcucga

SEQ ID NO: 1311 - RNA, 19 nt, Homo Sapiens
ugggaaggugcugugcucg

SEQ ID NO: 1312 - RNA, 19 nt, Homo Sapiens
ugggaagguuggauguucg

SEQ ID NO: 1313 - RNA, 21 nt, Homo Sapiens
uggcaaugugaucucgaagug

SEQ ID NO: 1314 - RNA, 22 nt, Homo Sapiens
ugggaagguggacgaugaaaug

SEQ ID NO: 1315 - RNA, 85 nt, Homo Sapiens
cacagaaucagaccaugacuaccuucaccuggaacaucaaccacgcccggcugauggugguggaggaaccgauguguuuacugug

SEQ ID NO: 1316 - RNA, 24 nt, Homo Sapiens
ugacuaccuucaccuggaacauca

SEQ ID NO: 1317 - RNA, 19 nt, Homo Sapiens
acaugcaccuggaaaacca

SEQ ID NO: 1318 - RNA, 16 nt, Homo Sapiens
acuaucaccuggagca

SEQ ID NO: 1319 - RNA, 25 nt, Homo Sapiens
cuacagcugcacuuguggaacauca

SEQ ID NO: 1320 - RNA, 19 nt, Homo Sapiens
uaccuucaccgagaacuca

SEQ ID NO: 1321 - RNA, 19 nt, Homo Sapiens
ugagccagcuucaccugga

SEQ ID NO: 1322 - RNA, 23 nt, Homo Sapiens
ugauuagcuucaagaccuggaac

SEQ ID NO: 1323 - RNA, 20 nt, Homo Sapiens
ugacuuuguccaccuggaac

SEQ ID NO: 1324 - RNA, 21 nt, Homo Sapiens
ugacuauggccaccuggaaca

SEQ ID NO: 1325 - RNA, 22 nt, Homo Sapiens
ugacugacgcaccuggaaaauc

SEQ ID NO: 1326 - RNA, 23 nt, Homo Sapiens
ugccucuuucacuaggaacauca

SEQ ID NO: 1327 - RNA, 84 nt, Homo Sapiens
cacagaaucagaccaugacuaccuucaccuggaacaucaaccacgcccggcugauggugguggaggaacgauguguuuacugug

SEQ ID NO: 1328 - RNA, 84 nt, Homo Sapiens; identical to SEQ ID NO: 1327

SEQ ID NO: 1329 - RNA, 84 nt, Homo Sapiens; identical to SEQ ID NO: 1327

SEQ ID NO: 1330 - RNA, 84 nt, Homo Sapiens; identical to SEQ ID NO: 1327

SEQ ID NO: 1331 - RNA, 84 nt, Homo Sapiens; identical to SEQ ID NO: 1327

SEQ ID NO: 1332 - RNA, 84 nt, Homo Sapiens; identical to SEQ ID NO: 1327

SEQ ID NO: 1333 - RNA, 84 nt, Homo Sapiens; identical to SEQ ID NO: 1327

SEQ ID NO: 1334 - RNA, 84 nt, Homo Sapiens; identical to SEQ ID NO: 1327

SEQ ID NO: 1335 - RNA, 84 nt, Homo Sapiens; identical to SEQ ID NO: 1327

SEQ ID NO: 1336 - RNA, 98 nt, Homo Sapiens
cacagacgaacaggcaaggggcuagggaagaagaggggacccaugucuucggaaauacaagggacuucugcaauccauggagaaugccaaauaaugug

SEQ ID NO: 1337 - RNA, 24 nt, Homo Sapiens
uacaagggacuucugcaauccaug

SEQ ID NO: 1338 - RNA, 21 nt, Homo Sapiens
aaguggaucuucugcaaccau

SEQ ID NO: 1339 - RNA, 22 nt, Homo Sapiens
aacgcacuguccuugcaaucca

SEQ ID NO: 1340 - RNA, 19 nt, Homo Sapiens
acaugggcaacuucugcaa

SEQ ID NO: 1341 - RNA, 21 nt, Homo Sapiens
acaagcgcgcucucugcaauc

SEQ ID NO: 1342 - RNA, 21 nt, Homo Sapiens
acaagggacauggccacucca

SEQ ID NO: 1343 - RNA, 20 nt, Homo Sapiens
caaguaggacuucuguaauc

SEQ ID NO: 1344 - RNA, 21 nt, Homo Sapiens
caaggcagaaaucugcaaucc

SEQ ID NO: 1345 - RNA, 25 nt, Homo Sapiens
caagggacuuccuguaacaaugcau

SEQ ID NO: 1346 - RNA, 21 nt, Homo Sapiens
uauaaggacuucugucacauc

SEQ ID NO: 1347 - RNA, 64 nt, Homo Sapiens
caccugccccagccccugccucugccccaaguggggccagcugcccucacuucugggguggaug

SEQ ID NO: 1348 - RNA, 24 nt, Homo Sapiens
accugccccagccccugccucugc

SEQ ID NO: 1349 - RNA, 27 nt, Homo Sapiens
acuugcuccugcagccccugccaccgc

SEQ ID NO: 1350 - RNA, 24 nt, Homo Sapiens
accagcccccagccccugaccugc

SEQ ID NO: 1351 - RNA, 23 nt, Homo Sapiens
acccgccccagccggcugccgcu

SEQ ID NO: 1352 - RNA, 21 nt, Homo Sapiens
accugccccacuccuggccuc

SEQ ID NO: 1353 - RNA, 22 nt, Homo Sapiens
accagcccgccccugcccccgc

SEQ ID NO: 1354 - RNA, 24 nt, Homo Sapiens
accgggcucugccucugccucugc

SEQ ID NO: 1355 - RNA, 21 nt, Homo Sapiens
cccagcccccucagccucugc

SEQ ID NO: 1356 - RNA, 18 nt, Homo Sapiens
cccagccccgccggucug

SEQ ID NO: 1357 - RNA, 23 nt, Homo Sapiens
ccccagccccagguggccucagc

SEQ ID NO: 1358 - RNA, 24 nt, Homo Sapiens
ccuggccccagccugguccuuccu

SEQ ID NO: 1359 - RNA, 24 nt, Homo Sapiens
ccugcccucagaacccugccucug

SEQ ID NO: 1360 - RNA, 20 nt, Homo Sapiens
ccggcccucagccccugucu

SEQ ID NO: 1361 - RNA, 23 nt, Homo Sapiens
ccucucccagcccccuuacucug

SEQ ID NO: 1362 - RNA, 20 nt, Homo Sapiens
ccugccccagcucccacccu

SEQ ID NO: 1363 - RNA, 21 nt, Homo Sapiens
ccugcccuagcucccugccuc

SEQ ID NO: 1364 - RNA, 25 nt, Homo Sapiens
ccuccccagccccuuuggccucagc

SEQ ID NO: 1365 - RNA, 20 nt, Homo Sapiens
ccugccccccacccugccuc

SEQ ID NO: 1366 - RNA, 21 nt, Homo Sapiens
ccgggcccaccgccugccucu

SEQ ID NO: 1367 - RNA, 22 nt, Homo Sapiens
cccgcccugcccccugccucug

SEQ ID NO: 1368 - RNA, 20 nt, Homo Sapiens
ccugccccagccugucucug

SEQ ID NO: 1369 - RNA, 23 nt, Homo Sapiens
ccuccgcccgccccugccccugc

SEQ ID NO: 1370 - RNA, 20 nt, Homo Sapiens
ccugccccaggcccgucugc

SEQ ID NO: 1371 - RNA, 20 nt, Homo Sapiens
cuucccugcagccugccucu

SEQ ID NO: 1372 - RNA, 24 nt, Homo Sapiens
cugccccaguuccaccugcccucu

SEQ ID NO: 1373 - RNA, 21 nt, Homo Sapiens
cugccccggcucccuccagcc

SEQ ID NO: 1374 - RNA, 20 nt, Homo Sapiens
cugccccagcccugguccuc

SEQ ID NO: 1375 - RNA, 21 nt, Homo Sapiens
cugccccagcuccugcucucu

SEQ ID NO: 1376 - RNA, 20 nt, Homo Sapiens
cugacgcauccccugccucu

SEQ ID NO: 1377 - RNA, 20 nt, Homo Sapiens
cuuccccagccccucccccu

SEQ ID NO: 1378 - RNA, 21 nt, Homo Sapiens
cugcccagccccugccucggc

SEQ ID NO: 1379 - RNA, 22 nt, Homo Sapiens
cugccccugccccugcccccgc

SEQ ID NO: 1380 - RNA, 22 nt, Homo Sapiens
cugccucugccucugccucugc

SEQ ID NO: 1381 - RNA, 22 nt, Homo Sapiens
cugucacagccccuggcuccgc

SEQ ID NO: 1382 - RNA, 21 nt, Homo Sapiens
gccccaagccauccugccucu

SEQ ID NO: 1383 - RNA, 19 nt, Homo Sapiens
gccccagccccagugccuc

SEQ ID NO: 1384 - RNA, 19 nt, Homo Sapiens
gccccugccccugccccug

SEQ ID NO: 1385 - RNA, 20 nt, Homo Sapiens
gcaccgggcucugccucugc

SEQ ID NO: 1386 - RNA, 20 nt, Homo Sapiens
gccacagccccugcccaugc

SEQ ID NO: 1387 - RNA, 20 nt, Homo Sapiens
gccccagcccccgccgccgc

SEQ ID NO: 1388 - RNA, 19 nt, Homo Sapiens
gcuccgccccugccccugc

SEQ ID NO: 1389 - RNA, 24 nt, Homo Sapiens
ugccccagccuccggcgccucugc

SEQ ID NO: 1390 - RNA, 23 nt, Homo Sapiens
ugccccagcccagugcccucugc

SEQ ID NO: 1391 - RNA, 64 nt, Homo Sapiens
cacuaacaacuucuggccgggccacggggcucaugccuuguaauucucagccagagggcgggug

SEQ ID NO: 1392 - RNA, 24 nt, Homo Sapiens
uaacaacuucuggccgggccacgg

SEQ ID NO: 1393 - RNA, 24 nt, Homo Sapiens
aacauuuuacuuggccgggcacgg

SEQ ID NO: 1394 - RNA, 22 nt, Homo Sapiens
aacauccacugcagccgggcca

SEQ ID NO: 1395 - RNA, 20 nt, Homo Sapiens
aacagcuucuggcccaggcc

SEQ ID NO: 1396 - RNA, 23 nt, Homo Sapiens
aacaacuucucggcggaucgcca

SEQ ID NO: 1397 - RNA, 21 nt, Homo Sapiens
aacugcucccacgggccacgg

SEQ ID NO: 1398 - RNA, 22 nt, Homo Sapiens
acagcuccgcgcagggccacgg

SEQ ID NO: 1399 - RNA, 22 nt, Homo Sapiens
acuucugguucuuccgggccac

SEQ ID NO: 1400 - RNA, 24 nt, Homo Sapiens
caacuucgagacguggccgggcca

SEQ ID NO: 1401 - RNA, 21 nt, Homo Sapiens
caacugccggccgggccgcgg

SEQ ID NO: 1402 - RNA, 22 nt, Homo Sapiens
uaagaacugaauguggccgggc

SEQ ID NO: 1403 - RNA, 61 nt, Homo Sapiens
cacuggccgaacucucggucucgggucuugaguggggcccgcagccgaagaguugcaggug

SEQ ID NO: 1404 - RNA, 24 nt, Homo Sapiens
uggccgaacucucggucucggguc

SEQ ID NO: 1405 - RNA, 22 nt, Homo Sapiens
ccgaacaucuuagggucucggg

SEQ ID NO: 1406 - RNA, 16 nt, Homo Sapiens
cccaacuggucucggg

SEQ ID NO: 1407 - RNA, 15 nt, Homo Sapiens
gaacugucucggguc

SEQ ID NO: 1408 - RNA, 20 nt, Homo Sapiens
ggccgcaacucucgggucgg

SEQ ID NO: 1409 - RNA, 18 nt, Homo Sapiens
gggcgacgcggucucggg

SEQ ID NO: 1410 - RNA, 23 nt, Homo Sapiens
uguccaacacccacucucggguc

SEQ ID NO: 1411 - RNA, 64 nt, Homo Sapiens
cacuuguaauccccccuguacuuaccuacucacauuggagaguucugaggccggaguaacugug

SEQ ID NO: 1412 - RNA, 24 nt, Homo Sapiens
aguucugaggccggaguaacugug

SEQ ID NO: 1413 - RNA, 25 nt, Homo Sapiens
aguaucuuaggacacuguaacugug

SEQ ID NO: 1414 - RNA, 26 nt, Homo Sapiens
aguucuuuuuuggccggaguaagcug

SEQ ID NO: 1415 - RNA, 21 nt, Homo Sapiens
aguucugaggccuggcaggaa

SEQ ID NO: 1416 - RNA, 25 nt, Homo Sapiens
agcucugaggccaagggaacaugug

SEQ ID NO: 1417 - RNA, 20 nt, Homo Sapiens
cugaggccggagaaagcugu

SEQ ID NO: 1418 - RNA, 18 nt, Homo Sapiens
cugggucugaguaacugu

SEQ ID NO: 1419 - RNA, 25 nt, Homo Sapiens
guucugagggccuggaggugaugug

SEQ ID NO: 1420 - RNA, 16 nt, Homo Sapiens
guucggacggaguaac

SEQ ID NO: 1421 - RNA, 20 nt, Homo Sapiens
guucugaggccuacugacug

SEQ ID NO: 1422 - RNA, 19 nt, Homo Sapiens
guucggacggaguaacgug

SEQ ID NO: 1423 - RNA, 20 nt, Homo Sapiens
guucugaggggaaaauugug

SEQ ID NO: 1424 - RNA, 21 nt, Homo Sapiens
uucugaggcgcacagucugug

SEQ ID NO: 1425 - RNA, 21 nt, Homo Sapiens
uucugaggcagagguaacugu

SEQ ID NO: 1426 - RNA, 21 nt, Homo Sapiens
uucugaggccagagaaacagu

SEQ ID NO: 1427 - RNA, 20 nt, Homo Sapiens
uucugaggccagucucggug

SEQ ID NO: 1428 - RNA, 67 nt, Homo Sapiens
cagaaugucagagcugagucugguguuacugacuaaggaacaaccugacucaggcucuagauggcug

SEQ ID NO: 1429 - RNA, 24 nt, Homo Sapiens
ugucagagcugagucugguguuac

SEQ ID NO: 1430 - RNA, 19 nt, Homo Sapiens
agugcugccagucuggugu

SEQ ID NO: 1431 - RNA, 23 nt, Homo Sapiens
agggcugagucugaaguaguuac

SEQ ID NO: 1432 - RNA, 17 nt, Homo Sapiens
cagagcugagcuuguua

SEQ ID NO: 1433 - RNA, 19 nt, Homo Sapiens
gucagauuaagcugagucu

SEQ ID NO: 1434 - RNA, 20 nt, Homo Sapiens
gucagagcuggagucggagu

SEQ ID NO: 1435 - RNA, 20 nt, Homo Sapiens
gucagagcugagucaguggu

SEQ ID NO: 1436 - RNA, 18 nt, Homo Sapiens
gucagagcuguugguguu

SEQ ID NO: 1437 - RNA, 21 nt, Homo Sapiens
ucagagcugggccgagcuguu

SEQ ID NO: 1438 - RNA, 19 nt, Homo Sapiens
uguacagagcugaggcagg

SEQ ID NO: 1439 - RNA, 19 nt, Homo Sapiens
ugucagagcugcuguaugg

SEQ ID NO: 1440 - RNA, 18 nt, Homo Sapiens
ugucagagcgagcucgug

SEQ ID NO: 1441 - RNA, 22 nt, Homo Sapiens
ugccugagcugaguuuucuguu

SEQ ID NO: 1442 - RNA, 22 nt, Homo Sapiens
ugucagagcugagucugcuguu

SEQ ID NO: 1443 - RNA, 71 nt, Homo Sapiens
cagagaucagaauacgaagcuuccucucagcaucaugggaggagauaaaauaauucauucuauggucuuug

SEQ ID NO: 1444 - RNA, 24 nt, Homo Sapiens
ggaggagauaaaauaauucauucu

SEQ ID NO: 1445 - RNA, 20 nt, Homo Sapiens
aggacgacaaaauaauucau

SEQ ID NO: 1446 - RNA, 24 nt, Homo Sapiens
aggagauuucaaaauaauucaauc

SEQ ID NO: 1447 - RNA, 19 nt, Homo Sapiens
aggagauaaaagaguuuau

SEQ ID NO: 1448 - RNA, 18 nt, Homo Sapiens
aggagaaaauaauucauu

SEQ ID NO: 1449 - RNA, 20 nt, Homo Sapiens
aguagauaaaauaauauauu

SEQ ID NO: 1450 - RNA, 21 nt, Homo Sapiens
agcaaauaaaauaauacauuc

SEQ ID NO: 1451 - RNA, 21 nt, Homo Sapiens
gagagagagagaaauaauuca

SEQ ID NO: 1452 - RNA, 18 nt, Homo Sapiens
gagaaaaauaauucaauc

SEQ ID NO: 1453 - RNA, 22 nt, Homo Sapiens
gaagacaucaaaauaauucuuu

SEQ ID NO: 1454 - RNA, 21 nt, Homo Sapiens
gagcaaauaacauaauucauu

SEQ ID NO: 1455 - RNA, 21 nt, Homo Sapiens
gagaagauaaacauucauucu

SEQ ID NO: 1456 - RNA, 24 nt, Homo Sapiens
ggauggggauaaaauaauuagucu

SEQ ID NO: 1457 - RNA, 24 nt, Homo Sapiens
ggagguaaagauaacaauaauuca

SEQ ID NO: 1458 - RNA, 20 nt, Homo Sapiens
ggagaggaaaaaauaauuca

SEQ ID NO: 1459 - RNA, 20 nt, Homo Sapiens
ggaugaguuaaaauaauuca

SEQ ID NO: 1460 - RNA, 22 nt, Homo Sapiens
ggaggagauaaaucaauggauu

SEQ ID NO: 1461 - RNA, 22 nt, Homo Sapiens
ggaggauaaaauaguugaaucu

SEQ ID NO: 1462 - RNA, 70 nt, Homo Sapiens
cagcaccauaacacuagacccagccuaacuguccugcaacaggggauggguaaaagggaugauggcgcug

SEQ ID NO: 1463 - RNA, 24 nt, Homo Sapiens
uaacacuagacccagccuaacugu

SEQ ID NO: 1464 - RNA, 23 nt, Homo Sapiens
aacagccuagacccagccaagcu

SEQ ID NO: 1465 - RNA, 19 nt, Homo Sapiens
aacauggggauggggaaaa

SEQ ID NO: 1466 - RNA, 20 nt, Homo Sapiens
aacacuagagccuagucuaa

SEQ ID NO: 1467 - RNA, 20 nt, Homo Sapiens
aacaucagccccagccuaac

SEQ ID NO: 1468 - RNA, 22 nt, Homo Sapiens
aacaauggaauggguaaagagg

SEQ ID NO: 1469 - RNA, 23 nt, Homo Sapiens
aacaagagauggacguaaaaggg

SEQ ID NO: 1470 - RNA, 19 nt, Homo Sapiens
aagagaggagguaaaaggg

SEQ ID NO: 1471 - RNA, 20 nt, Homo Sapiens
acaggcagggcuggguaaaa

SEQ ID NO: 1472 - RNA, 22 nt, Homo Sapiens
acagggugcaugauggguaaaa

SEQ ID NO: 1473 - RNA, 22 nt, Homo Sapiens
acagggacaugaugguaaaagg

SEQ ID NO: 1474 - RNA, 18 nt, Homo Sapiens
acaagagaggguaaaagg

SEQ ID NO: 1475 - RNA, 21 nt, Homo Sapiens
caacaggggaaggaaguaaaa

SEQ ID NO: 1476 - RNA, 22 nt, Homo Sapiens
caccggacccagcccagacugu

SEQ ID NO: 1477 - RNA, 18 nt, Homo Sapiens
cacagcccagccuaccug

SEQ ID NO: 1478 - RNA, 18 nt, Homo Sapiens
cacuagaccaugcccugu

SEQ ID NO: 1479 - RNA, 20 nt, Homo Sapiens
caggguuguagggguaaaag

SEQ ID NO: 1480 - RNA, 19 nt, Homo Sapiens
cagggaaagggguaaaagg

SEQ ID NO: 1481 - RNA, 23 nt, Homo Sapiens
uaacacuaguuccaagacuaacu

SEQ ID NO: 1482 - RNA, 17 nt, Homo Sapiens
uaacaagacccagcuua

SEQ ID NO: 1483 - RNA, 22 nt, Homo Sapiens
uggaacgaggggaggguaaaag

SEQ ID NO: 1484 - RNA, 19 nt, Homo Sapiens
ugcaacaggucauugguaa

SEQ ID NO: 1485 - RNA, 19 nt, Homo Sapiens
ugaaacaggggaguuaaaa

SEQ ID NO: 1486 - RNA, 22 nt, Homo Sapiens
ugcaacaggagaauugaaaaag

SEQ ID NO: 1487 - RNA, 67 nt, Homo Sapiens
cagcaucugguccuuuugcugugacccaccccaucccggagcuggucgggucuggcuggaugugcug

SEQ ID NO: 1488 - RNA, 24 nt, Homo Sapiens
ucugguccuuuugcugugacccac

SEQ ID NO: 1489 - RNA, 15 nt, Homo Sapiens
cuggugcaccugcug

SEQ ID NO: 1490 - RNA, 22 nt, Homo Sapiens
cuugucuuuuugcuguccccac

SEQ ID NO: 1491 - RNA, 9 nt, Homo Sapiens
gugacccac

SEQ ID NO: 1492 - RNA, 20 nt, Homo Sapiens
uguucauuuugcuguugacc

SEQ ID NO: 1493 - RNA, 14 nt, Homo Sapiens
uuuugcuguguacc

SEQ ID NO: 1494 - RNA, 64 nt, Homo Sapiens
cagcccacgccuggggagccugccuggggccaugugaccauggccucucccugggaacgggcug

SEQ ID NO: 1495 - RNA, 24 nt, Homo Sapiens
uggccucucccugggaacgggcug

SEQ ID NO: 1496 - RNA, 24 nt, Homo Sapiens
ccucucccuggccguucgggacug

SEQ ID NO: 1497 - RNA, 19 nt, Homo Sapiens
ccucucccugcgccggggc

SEQ ID NO: 1498 - RNA, 19 nt, Homo Sapiens
ccccucccugggaaggccu

SEQ ID NO: 1499 - RNA, 26 nt, Homo Sapiens
gccucuagucccugcggaacgggcug

SEQ ID NO: 1500 - RNA, 26 nt, Homo Sapiens
gccucucccacgugggagaggggcug

SEQ ID NO: 1501 - RNA, 26 nt, Homo Sapiens
gccucucccgaguggcgacggcgcug

SEQ ID NO: 1502 - RNA, 19 nt, Homo Sapiens
gccucucccuguggggaac

SEQ ID NO: 1503 - RNA, 23 nt, Homo Sapiens
gccuuucccugggacagagggcu

SEQ ID NO: 1504 - RNA, 19 nt, Homo Sapiens
gccucucccaggaaggggc

SEQ ID NO: 1505 - RNA, 19 nt, Homo Sapiens
gccucucccgagcgcgcug

SEQ ID NO: 1506 - RNA, 18 nt, Homo Sapiens
ggccucucccgcgggcug

SEQ ID NO: 1507 - RNA, 23 nt, Homo Sapiens
uggcaauccccugggaacggcug

SEQ ID NO: 1508 - RNA, 23 nt, Homo Sapiens
uggccucucuccuggccacaggc

SEQ ID NO: 1509 - RNA, 23 nt, Homo Sapiens
uggccucuccucucugaaggggc

SEQ ID NO: 1510 - RNA, 18 nt, Homo Sapiens
ugcccucuccugggaacg

SEQ ID NO: 1511 - RNA, 18 nt, Homo Sapiens
ugaccucucccugacggg

SEQ ID NO: 1512 - RNA, 19 nt, Homo Sapiens
uggcagcucccugggcggg

SEQ ID NO: 1513 - RNA, 20 nt, Homo Sapiens
ugcccucucccugcaggcug

SEQ ID NO: 1514 - RNA, 22 nt, Homo Sapiens
uggccucucccaggcugggcug

SEQ ID NO: 1515 - RNA, 73 nt, Homo Sapiens
caggcccuaggagggcgagggcuuaguagguaucuucagggucagagccugaguccucgccuuguugguucug

SEQ ID NO: 1516 - RNA, 24 nt, Homo Sapiens
uaggagggcgagggcuuaguaggu

SEQ ID NO: 1517 - RNA, 19 nt, Homo Sapiens
aggagggcgaguuacuugg

SEQ ID NO: 1518 - RNA, 19 nt, Homo Sapiens
agggcgaggguuacgcagg

SEQ ID NO: 1519 - RNA, 19 nt, Homo Sapiens
gagggcgagguuagagggu

SEQ ID NO: 1520 - RNA, 21 nt, Homo Sapiens
ggacgagcgagggcucagagg

SEQ ID NO: 1521 - RNA, 22 nt, Homo Sapiens
ggcgggcgaggggggucguagg

SEQ ID NO: 1522 - RNA, 21 nt, Homo Sapiens
gggcgagggcaggacguaggu

SEQ ID NO: 1523 - RNA, 24 nt, Homo Sapiens
uaggagggcggcaggggaggaggu

SEQ ID NO: 1524 - RNA, 25 nt, Homo Sapiens
uagcauggcaagggcuuagcauggu

SEQ ID NO: 1525 - RNA, 61 nt, Homo Sapiens
cagugugcacgugggaaccuguccccaggcuggagcauaggggcaugaucccagcucacug

SEQ ID NO: 1526 - RNA, 24 nt, Homo Sapiens
uaggggcaugaucccagcucacug

SEQ ID NO: 1527 - RNA, 20 nt, Homo Sapiens
aggugccaagucccagcuca

SEQ ID NO: 1528 - RNA, 25 nt, Homo Sapiens
aggggccucagaccgcagcucacug

SEQ ID NO: 1529 - RNA, 22 nt, Homo Sapiens
aggcgccuguaaucccagcuca

SEQ ID NO: 1530 - RNA, 23 nt, Homo Sapiens
aggcgccugcgaucccagcuacu

SEQ ID NO: 1531 - RNA, 23 nt, Homo Sapiens
aggcgccuguaaucccagcuacu

SEQ ID NO: 1532 - RNA, 22 nt, Homo Sapiens
aguggcaugaucguagcucacu

SEQ ID NO: 1533 - RNA, 23 nt, Homo Sapiens
aggggcaugauaucagcucacug

SEQ ID NO: 1534 - RNA, 23 nt, Homo Sapiens
aggggcaugaucucaacucacug

SEQ ID NO: 1535 - RNA, 23 nt, Homo Sapiens
aguggcaagaucucagcucacug

SEQ ID NO: 1536 - RNA, 23 nt, Homo Sapiens
aguggcaccaucucagcucacug

SEQ ID NO: 1537 - RNA, 23 nt, Homo Sapiens
aguggcacgaucucagcucacug

SEQ ID NO: 1538 - RNA, 23 nt, Homo Sapiens
aguggcaucaucauagcucacug

SEQ ID NO: 1539 - RNA, 23 nt, Homo Sapiens
aguggcaugaucauagcuuacug

SEQ ID NO: 1540 - RNA, 23 nt, Homo Sapiens
aguggcaugaucauggcucacug

SEQ ID NO: 1541 - RNA, 23 nt, Homo Sapiens
aguggcaugauccaggcucacug

SEQ ID NO: 1542 - RNA, 23 nt, Homo Sapiens
aguggcaugaucucggcucacug

SEQ ID NO: 1543 - RNA, 23 nt, Homo Sapiens
aguggcaugaucuuggcucacug

SEQ ID NO: 1544 - RNA, 23 nt, Homo Sapiens
aguggcgugaucucagcucacug

SEQ ID NO: 1545 - RNA, 23 nt, Homo Sapiens
aguggugugaucucagcucacug

SEQ ID NO: 1546 - RNA, 22 nt, Homo Sapiens
agugcugcugguaggaaccugu

SEQ ID NO: 1547 - RNA, 28 nt, Homo Sapiens
agugugggcgucacgugggaacguggcc

SEQ ID NO: 1548 - RNA, 18 nt, Homo Sapiens
aguaggccuugggaaccu

SEQ ID NO: 1549 - RNA, 20 nt, Homo Sapiens
agugugcacauggcaccugu

SEQ ID NO: 1550 - RNA, 23 nt, Homo Sapiens
aggguucccguucaaccuguccc

SEQ ID NO: 1551 - RNA, 20 nt, Homo Sapiens
augaucccagugccugacug

SEQ ID NO: 1552 - RNA, 19 nt, Homo Sapiens
gcacgaucucagcucacug

SEQ ID NO: 1553 - RNA, 19 nt, Homo Sapiens
gcaugaucucagcucacug

SEQ ID NO: 1554 - RNA, 19 nt, Homo Sapiens
ggcaagaauucagcucacu

SEQ ID NO: 1555 - RNA, 20 nt, Homo Sapiens
ggcacgaucucagcucacug

SEQ ID NO: 1556 - RNA, 20 nt, Homo Sapiens
ggcauaaucacagcucacug

SEQ ID NO: 1557 - RNA, 20 nt, Homo Sapiens
ggcaugaucucagcucacug

SEQ ID NO: 1558 - RNA, 20 nt, Homo Sapiens
ggcaugaucucagcucauug

SEQ ID NO: 1559 - RNA, 20 nt, Homo Sapiens
ggcaugaucucagcucgcug

SEQ ID NO: 1560 - RNA, 20 nt, Homo Sapiens
ggcaugaucucggcucacug

SEQ ID NO: 1561 - RNA, 20 nt, Homo Sapiens
ggcgugaucucagcucacug

SEQ ID NO: 1562 - RNA, 21 nt, Homo Sapiens
gggcaugauggcaugcuccug

SEQ ID NO: 1563 - RNA, 21 nt, Homo Sapiens
gggggauuugcucccagcuca

SEQ ID NO: 1564 - RNA, 22 nt, Homo Sapiens
ggcgccugcaaucccagcuacu

SEQ ID NO: 1565 - RNA, 22 nt, Homo Sapiens
ggcgccuguaaucccagcuacu

SEQ ID NO: 1566 - RNA, 22 nt, Homo Sapiens
ggugccuguaaucccagcuacu

SEQ ID NO: 1567 - RNA, 19 nt, Homo Sapiens
guucacaggaaaccugucc

SEQ ID NO: 1568 - RNA, 20 nt, Homo Sapiens
gugggcacgugggcacgcug

SEQ ID NO: 1569 - RNA, 21 nt, Homo Sapiens
uacgcgccuggaucccagcuc

SEQ ID NO: 1570 - RNA, 24 nt, Homo Sapiens
uaguggcaugaucucaccacacug

SEQ ID NO: 1571 - RNA, 20 nt, Homo Sapiens
uggacgucccgaaccugucc

SEQ ID NO: 1572 - RNA, 18 nt, Homo Sapiens
uguaugugaaaccugucc

SEQ ID NO: 1573 - RNA, 23 nt, Homo Sapiens
ugagcaccuggucuaccuguccc

SEQ ID NO: 1574 - RNA, 24 nt, Homo Sapiens
ugagcacgugggcgcuuggguccc

SEQ ID NO: 1575 - RNA, 65 nt, Homo Sapiens
caucucacuaagugcugaucaguuuugauucaguuggaguagagcacauagguucuuuggagaug

SEQ ID NO: 1576 - RNA, 24 nt, Homo Sapiens
ucucacuaagugcugaucaguuuu

SEQ ID NO: 1577 - RNA, 24 nt, Homo Sapiens
cacaaguccagcuugaucaguuuu

SEQ ID NO: 1578 - RNA, 17 nt, Homo Sapiens
cucacuaagagcaucag

SEQ ID NO: 1579 - RNA, 20 nt, Homo Sapiens
ucacuaaguggcccugacag

SEQ ID NO: 1580 - RNA, 21 nt, Homo Sapiens
ucacuaaguacaugguaaguu

SEQ ID NO: 1581 - RNA, 19 nt, Homo Sapiens
ucuuacuguaagugcugau

SEQ ID NO: 1582 - RNA, 20 nt, Homo Sapiens
ucugaccacagugcugauca

SEQ ID NO: 1583 - RNA, 24 nt, Homo Sapiens
ucucacuaaugccucgcuuaucag

SEQ ID NO: 1584 - RNA, 18 nt, Homo Sapiens
ucucacuaagcuguccag

SEQ ID NO: 1585 - RNA, 19 nt, Homo Sapiens
ucuagcuaagcugaucagu

SEQ ID NO: 1586 - RNA, 24 nt, Homo Sapiens
ucuaaauaaauuuucaucaguuuu

SEQ ID NO: 1587 - RNA, 22 nt, Homo Sapiens
ucucucaaaacugaucaguuuu

SEQ ID NO: 1588 - RNA, 20 nt, Homo Sapiens
ucuuccuaagcaucaguuuu

SEQ ID NO: 1589 - RNA, 77 nt, Homo Sapiens
caugaaagaagccugguuacugauuuguauaaaauguacucuuaaaguauaaaguauaagguaagguaaauuucaug

SEQ ID NO: 1590 - RNA, 24 nt, Homo Sapiens
uaaaguauaagguaagguaaauuu

SEQ ID NO: 1591 - RNA, 23 nt, Homo Sapiens
aaaguauaacagggaggauaaau

SEQ ID NO: 1592 - RNA, 19 nt, Homo Sapiens
aaaguauaagaaaaaggua

SEQ ID NO: 1593 - RNA, 25 nt, Homo Sapiens
aaaauauaaggauaaaaagguaaau

SEQ ID NO: 1594 - RNA, 21 nt, Homo Sapiens
aaacucuaagguaagcgguaa

SEQ ID NO: 1595 - RNA, 20 nt, Homo Sapiens
aaauaaaaagguaaggaaaa

SEQ ID NO: 1596 - RNA, 20 nt, Homo Sapiens
aaaauguaauuaagguaaau

SEQ ID NO: 1597 - RNA, 20 nt, Homo Sapiens
aaaguauaacugaaggaaau

SEQ ID NO: 1598 - RNA, 19 nt, Homo Sapiens
aaaguaucugaagguaaau

SEQ ID NO: 1599 - RNA, 22 nt, Homo Sapiens
aaaguauaaaguauggaaaauu

SEQ ID NO: 1600 - RNA, 23 nt, Homo Sapiens
aaaaaauaagguaauguuauuuu

SEQ ID NO: 1601 - RNA, 18 nt, Homo Sapiens
aagagaaaauaagguaaa

SEQ ID NO: 1602 - RNA, 18 nt, Homo Sapiens
aagaucagguaaggugaa

SEQ ID NO: 1603 - RNA, 21 nt, Homo Sapiens
aaguauaagaaaaauaauuuu

SEQ ID NO: 1604 - RNA, 18 nt, Homo Sapiens
aguauaaggcagguagau

SEQ ID NO: 1605 - RNA, 19 nt, Homo Sapiens
aguauaagguacuauaaau

SEQ ID NO: 1606 - RNA, 24 nt, Homo Sapiens
guaaaaggaaauaaggguaaauuu

SEQ ID NO: 1607 - RNA, 24 nt, Homo Sapiens
uaaaguauaaaggcaaaggaaaau

SEQ ID NO: 1608 - RNA, 21 nt, Homo Sapiens
uaaaguauacaggcaguguaa

SEQ ID NO: 1609 - RNA, 25 nt, Homo Sapiens
uaaaguauacaagaauguaauauuu

SEQ ID NO: 1610 - RNA, 27 nt, Homo Sapiens
uaaaguauaagugcuaaagagguaaau

SEQ ID NO: 1611 - RNA, 21 nt, Homo Sapiens
uaaagacaauauaagguaaau

SEQ ID NO: 1612 - RNA, 23 nt, Homo Sapiens
uaaaguauauggaaaaauagauu

SEQ ID NO: 1613 - RNA, 23 nt, Homo Sapiens
uaaaguauaaauuaguucaauuu

SEQ ID NO: 1614 - RNA, 23 nt, Homo Sapiens
uaaaguauaacaaaaagauauuu

SEQ ID NO: 1615 - RNA, 23 nt, Homo Sapiens
uagagaaugaguaagguaaguuu

SEQ ID NO: 1616 - RNA, 64 nt, Homo Sapiens
caugacaacagacacauugacauggguggguuuacccgccaagcggucgauggucuucugugug

SEQ ID NO: 1617 - RNA, 24 nt, Homo Sapiens
ugacaacagacacauugacauggg

SEQ ID NO: 1618 - RNA, 20 nt, Homo Sapiens
aacagacacaaugaccuggg

SEQ ID NO: 1619 - RNA, 20 nt, Homo Sapiens
aauacacacacugacauggg

SEQ ID NO: 1620 - RNA, 22 nt, Homo Sapiens
acagacagacacauagaucugg

SEQ ID NO: 1621 - RNA, 22 nt, Homo Sapiens
accacagacacacuugcccaug

SEQ ID NO: 1622 - RNA, 19 nt, Homo Sapiens
acaugagaagcauugacau

SEQ ID NO: 1623 - RNA, 18 nt, Homo Sapiens
acaacagaccuuuacaug

SEQ ID NO: 1624 - RNA, 20 nt, Homo Sapiens
acaauagauguugacauggg

SEQ ID NO: 1625 - RNA, 20 nt, Homo Sapiens
acagcgacucuugacauggg

SEQ ID NO: 1626 - RNA, 22 nt, Homo Sapiens
acagacacauggucacacaugg

SEQ ID NO: 1627 - RNA, 17 nt, Homo Sapiens
acagacacaggcuuggg

SEQ ID NO: 1628 - RNA, 17 nt, Homo Sapiens
acagacacauucuuggg

SEQ ID NO: 1629 - RNA, 20 nt, Homo Sapiens
gacacacagacacauacaca

SEQ ID NO: 1630 - RNA, 21 nt, Homo Sapiens
gacacacagacacacauacau

SEQ ID NO: 1631 - RNA, 25 nt, Homo Sapiens
gacaauuuauacacauugaaauggg

SEQ ID NO: 1632 - RNA, 22 nt, Homo Sapiens
gacaucagguuacacauugaca

SEQ ID NO: 1633 - RNA, 19 nt, Homo Sapiens
gaaaacagauacauugaca

SEQ ID NO: 1634 - RNA, 19 nt, Homo Sapiens
gacaacagauaaauuaaca

SEQ ID NO: 1635 - RNA, 20 nt, Homo Sapiens
gacacagacacauucuuggg

SEQ ID NO: 1636 - RNA, 23 nt, Homo Sapiens
ugacaacagaagccaaauuuaca

SEQ ID NO: 1637 - RNA, 21 nt, Homo Sapiens
ugacaaauacuuacauugaca

SEQ ID NO: 1638 - RNA, 23 nt, Homo Sapiens
ugacaaaauauugacauugacau

SEQ ID NO: 1639 - RNA, 20 nt, Homo Sapiens
ugaaacagacacaguuauau

SEQ ID NO: 1640 - RNA, 20 nt, Homo Sapiens
ugccaaaaauacauugacau

SEQ ID NO: 1641 - RNA, 22 nt, Homo Sapiens
ugacaccugcuacuugacaugg

SEQ ID NO: 1642 - RNA, 22 nt, Homo Sapiens
ugacaacagaaucugucauggg

SEQ ID NO: 1643 - RNA, 63 nt, Homo Sapiens
caugacaacagacacauugacauggguggguuuaccgccaagcggucgauggucuucugugug

SEQ ID NO: 1644 - RNA, 63 nt, Homo Sapiens; identical to SEQ ID NO: 1643

SEQ ID NO: 1645 - RNA, 63 nt, Homo Sapiens; identical to SEQ ID NO: 1643

SEQ ID NO: 1646 - RNA, 63 nt, Homo Sapiens; identical to SEQ ID NO: 1643

SEQ ID NO: 1647 - RNA, 63 nt, Homo Sapiens; identical to SEQ ID NO: 1643

SEQ ID NO: 1648 - RNA, 63 nt, Homo Sapiens; identical to SEQ ID NO: 1643

SEQ ID NO: 1649 - RNA, 63 nt, Homo Sapiens; identical to SEQ ID NO: 1643

SEQ ID NO: 1650 - RNA, 63 nt, Homo Sapiens; identical to SEQ ID NO: 1643

SEQ ID NO: 1651 - RNA, 63 nt, Homo Sapiens; identical to SEQ ID NO: 1643

SEQ ID NO: 1652 - RNA, 63 nt, Homo Sapiens; identical to SEQ ID NO: 1643

SEQ ID NO: 1653 - RNA, 63 nt, Homo Sapiens; identical to SEQ ID NO: 1643

SEQ ID NO: 1654 - RNA, 63 nt, Homo Sapiens; identical to SEQ ID NO: 1643

SEQ ID NO: 1655 - RNA, 63 nt, Homo Sapiens; identical to SEQ ID NO: 1643

SEQ ID NO: 1656 - RNA, 63 nt, Homo Sapiens; identical to SEQ ID NO: 1643

SEQ ID NO: 1657 - RNA, 63 nt, Homo Sapiens; identical to SEQ ID NO: 1643

SEQ ID NO: 1658 - RNA, 63 nt, Homo Sapiens; identical to SEQ ID NO: 1643

SEQ ID NO: 1659 - RNA, 63 nt, Homo Sapiens; identical to SEQ ID NO: 1643

SEQ ID NO: 1660 - RNA, 63 nt, Homo Sapiens; identical to SEQ ID NO: 1643

SEQ ID NO: 1661 - RNA, 63 nt, Homo Sapiens; identical to SEQ ID NO: 1643

SEQ ID NO: 1662 - RNA, 63 nt, Homo Sapiens; identical to SEQ ID NO: 1643

SEQ ID NO: 1663 - RNA, 63 nt, Homo Sapiens; identical to SEQ ID NO: 1643

SEQ ID NO: 1664 - RNA, 63 nt, Homo Sapiens; identical to SEQ ID NO: 1643

SEQ ID NO: 1665 - RNA, 63 nt, Homo Sapiens; identical to SEQ ID NO: 1643

SEQ ID NO: 1666 - RNA, 63 nt, Homo Sapiens; identical to SEQ ID NO: 1643

SEQ ID NO: 1667 - RNA, 79 nt, Homo Sapiens
caugcuugagcaaaacaacagacauuggugagggcugggucgccuggaccacaaguuugacugauguuugccaggcgug

SEQ ID NO: 1668 - RNA, 24 nt, Homo Sapiens
aacaacagacauuggugagggcug

SEQ ID NO: 1669 - RNA, 20 nt, Homo Sapiens
aacagagcagacauugguga

SEQ ID NO: 1670 - RNA, 24 nt, Homo Sapiens
aagaaaagaaugucauuggugagg

SEQ ID NO: 1671 - RNA, 21 nt, Homo Sapiens
aacaacagaucauucuuuagg

SEQ ID NO: 1672 - RNA, 26 nt, Homo Sapiens
aacagcagacauuggggucagggcug

SEQ ID NO: 1673 - RNA, 20 nt, Homo Sapiens
aacaacagaugcuggagagg

SEQ ID NO: 1674 - RNA, 22 nt, Homo Sapiens
aacaacagacugguguggccug

SEQ ID NO: 1675 - RNA, 21 nt, Homo Sapiens
aacauaagaaagugagggcug

SEQ ID NO: 1676 - RNA, 19 nt, Homo Sapiens
aacagacaugaugaugggc

SEQ ID NO: 1677 - RNA, 24 nt, Homo Sapiens
acaacagacagugagagagaguug

SEQ ID NO: 1678 - RNA, 19 nt, Homo Sapiens
acaaaaguuguuggugagg

SEQ ID NO: 1679 - RNA, 21 nt, Homo Sapiens
acacacacuuugugagggcug

SEQ ID NO: 1680 - RNA, 21 nt, Homo Sapiens
acacgcaugcggugagggcug

SEQ ID NO: 1681 - RNA, 22 nt, Homo Sapiens
caacagacaccuuggucgaagg

SEQ ID NO: 1682 - RNA, 20 nt, Homo Sapiens
caacagacaucugugggugc

SEQ ID NO: 1683 - RNA, 22 nt, Homo Sapiens
cagacagggugugugagggcug

SEQ ID NO: 1684 - RNA, 62 nt, Homo Sapiens
caugugaugauaauggucuucucgccaucccaagauggguuggcagccaugaucuuugcaug

SEQ ID NO: 1685 - RNA, 24 nt, Homo Sapiens
ugugaugauaauggucuucucgcc

SEQ ID NO: 1686 - RNA, 17 nt, Homo Sapiens
augauaauguuuucgcc

SEQ ID NO: 1687 - RNA, 19 nt, Homo Sapiens
gauaauggugcuacuucuc

SEQ ID NO: 1688 - RNA, 20 nt, Homo Sapiens
gauaaugcugccuucucgcc

SEQ ID NO: 1689 - RNA, 21 nt, Homo Sapiens
guggucgagaagggucuucuc

SEQ ID NO: 1690 - RNA, 19 nt, Homo Sapiens
gugaggacuaaauggucuu

SEQ ID NO: 1691 - RNA, 23 nt, Homo Sapiens
gugaugauagucaugguuuuuuc

SEQ ID NO: 1692 - RNA, 19 nt, Homo Sapiens
gugaugauaaucugaucgc

SEQ ID NO: 1693 - RNA, 20 nt, Homo Sapiens
ugaguggaaauggucuucuc

SEQ ID NO: 1694 - RNA, 19 nt, Homo Sapiens
ugagaaagcccuucucgcc

SEQ ID NO: 1695 - RNA, 19 nt, Homo Sapiens
ugauaaugguguaccugcc

SEQ ID NO: 1696 - RNA, 21 nt, Homo Sapiens
ugaugauaaaugguuccuggc

SEQ ID NO: 1697 - RNA, 21 nt, Homo Sapiens
ugaaaauacaugucuucucgc

SEQ ID NO: 1698 - RNA, 19 nt, Homo Sapiens
uguaauugaaggucuucuc

SEQ ID NO: 1699 - RNA, 60 nt, Homo Sapiens
cauguuauaccuggaaaggaccgugggcacuaaucugcacuuuguuccagguaauccaug

SEQ ID NO: 1700 - RNA, 24 nt, Homo Sapiens
uguuauaccuggaaaggaccgugg

SEQ ID NO: 1701 - RNA, 19 nt, Homo Sapiens
gugauccccagaaaggacc

SEQ ID NO: 1702 - RNA, 76 nt, Homo Sapiens
cauguuauagauuauuuggaaagacuguauuucccauugucacaaagcaaguuuauuucaaaugcuuuaucacaug

SEQ ID NO: 1703 - RNA, 24 nt, Homo Sapiens
uguuauagauuauuuggaaagacu

SEQ ID NO: 1704 - RNA, 22 nt, Homo Sapiens
auaguuuuuuucuggaaagacu

SEQ ID NO: 1705 - RNA, 21 nt, Homo Sapiens
auggaguauuuaggaaagacu

SEQ ID NO: 1706 - RNA, 18 nt, Homo Sapiens
auaauuuauuuggaagac

SEQ ID NO: 1707 - RNA, 26 nt, Homo Sapiens
guuauaaagcauuauuuggcaaagac

SEQ ID NO: 1708 - RNA, 21 nt, Homo Sapiens
uaaaaaauauuuggaaaaacu

SEQ ID NO: 1709 - RNA, 19 nt, Homo Sapiens
ugcuauaugaauuauuugg

SEQ ID NO: 1710 - RNA, 23 nt, Homo Sapiens
ugugauaguaccuuauuuggaaa

SEQ ID NO: 1711 - RNA, 22 nt, Homo Sapiens
uguuauagaacuucuuuugaaa

SEQ ID NO: 1712 - RNA, 23 nt, Homo Sapiens
uguuauagauuuucauauuugga

SEQ ID NO: 1713 - RNA, 18 nt, Homo Sapiens
uguuccaaauauuuggaa

SEQ ID NO: 1714 - RNA, 19 nt, Homo Sapiens
uguucaaauuauuuggaaa

SEQ ID NO: 1715 - RNA, 23 nt, Homo Sapiens
uuauuagauuacuuuuuggaaag

SEQ ID NO: 1716 - RNA, 21 nt, Homo Sapiens
uuauagauuuauuuucaaaga

SEQ ID NO: 1717 - RNA, 20 nt, Homo Sapiens
uuauagauuaacuauggaaa

SEQ ID NO: 1718 - RNA, 21 nt, Homo Sapiens
uuaaagguuaauuuuggaaag

SEQ ID NO: 1719 - RNA, 21 nt, Homo Sapiens
uuauaucuuacuuuggaaaga

SEQ ID NO: 1720 - RNA, 18 nt, Homo Sapiens
uuauagauuuguggaaag

SEQ ID NO: 1721 - RNA, 20 nt, Homo Sapiens
uuaaauguuauuuggaaaga

SEQ ID NO: 1722 - RNA, 66 nt, Homo Sapiens
cauuccugagggguuggccucaugacccaaagacacccauuaggccccagcuccaacauugggaug

SEQ ID NO: 1723 - RNA, 24 nt, Homo Sapiens
uuaggccccagcuccaacauuggg

SEQ ID NO: 1724 - RNA, 21 nt, Homo Sapiens
aggccugcugcuccaacauug

SEQ ID NO: 1725 - RNA, 23 nt, Homo Sapiens
aggcacagacuagccaacauugg

SEQ ID NO: 1726 - RNA, 23 nt, Homo Sapiens
aggccccagcaccugagcauugg

SEQ ID NO: 1727 - RNA, 19 nt, Homo Sapiens
aggccccagcuccucauug

SEQ ID NO: 1728 - RNA, 20 nt, Homo Sapiens
aggccccaggcccacauagg

SEQ ID NO: 1729 - RNA, 22 nt, Homo Sapiens
agcccucaccuggaacauuggg

SEQ ID NO: 1730 - RNA, 21 nt, Homo Sapiens
aggccccagcccaagacuggg

SEQ ID NO: 1731 - RNA, 20 nt, Homo Sapiens
uaggccccaggcaaacuugg

SEQ ID NO: 1732 - RNA, 18 nt, Homo Sapiens
uuaggccccagcucacau

SEQ ID NO: 1733 - RNA, 19 nt, Homo Sapiens
uucggccccagcaaacauu

SEQ ID NO: 1734 - RNA, 77 nt, Homo Sapiens
cauucuggauuuggucgauugcuucuuuuuaguaucuuuaacuuauuagaucucaaacucagcugcacaucagaaug

SEQ ID NO: 1735 - RNA, 24 nt, Homo Sapiens
uuagaucucaaacucagcugcaca

SEQ ID NO: 1736 - RNA, 24 nt, Homo Sapiens
agaaaugacacucugagcugcaca

SEQ ID NO: 1737 - RNA, 23 nt, Homo Sapiens
agcucggaaacccgagcugcaca

SEQ ID NO: 1738 - RNA, 17 nt, Homo Sapiens
agaucucaauagcugca

SEQ ID NO: 1739 - RNA, 20 nt, Homo Sapiens
agauuccaccccagcugcac

SEQ ID NO: 1740 - RNA, 19 nt, Homo Sapiens
cucaaagcugucagcugca

SEQ ID NO: 1741 - RNA, 72 nt, Homo Sapiens
ccaacaggaugccacgcugggccgagcgacuauuuccugccaauguugcucacucgguguacguccuggagg

SEQ ID NO: 1742 - RNA, 21 nt, Homo Sapiens
acucgguguacguccuggagg

SEQ ID NO: 1743 - RNA, 21 nt, Homo Sapiens
aacugugaugccacgcuccga

SEQ ID NO: 1744 - RNA, 19 nt, Homo Sapiens
acagggaugccacccgggc

SEQ ID NO: 1745 - RNA, 22 nt, Homo Sapiens
acaggaugccugacccucgucc

SEQ ID NO: 1746 - RNA, 18 nt, Homo Sapiens
acaggaugccacgcgggc

SEQ ID NO: 1747 - RNA, 19 nt, Homo Sapiens
acaggaugccacgcgggcc

SEQ ID NO: 1748 - RNA, 22 nt, Homo Sapiens
acugcagugcucauccuggagg

SEQ ID NO: 1749 - RNA, 20 nt, Homo Sapiens
acucagaggguguccuggag

SEQ ID NO: 1750 - RNA, 21 nt, Homo Sapiens
acucgguguacaugcugcagg

SEQ ID NO: 1751 - RNA, 21 nt, Homo Sapiens
aggcugucaccucgcugggcc

SEQ ID NO: 1752 - RNA, 18 nt, Homo Sapiens
caaucaggagccacgcug

SEQ ID NO: 1753 - RNA, 19 nt, Homo Sapiens
caaccagggccacgcuggg

SEQ ID NO: 1754 - RNA, 25 nt, Homo Sapiens
caacaggaucgggaccacggagggc

SEQ ID NO: 1755 - RNA, 26 nt, Homo Sapiens
caccauguugaccacgcuggucucga

SEQ ID NO: 1756 - RNA, 18 nt, Homo Sapiens
caagagaugccacgcugg

SEQ ID NO: 1757 - RNA, 18 nt, Homo Sapiens
caccaggguccacgcugg

SEQ ID NO: 1758 - RNA, 21 nt, Homo Sapiens
caacaggaugaacacagggcc

SEQ ID NO: 1759 - RNA, 21 nt, Homo Sapiens
caggguucgccagcugggccg

SEQ ID NO: 1760 - RNA, 20 nt, Homo Sapiens
caggagagccggcugggccg

SEQ ID NO: 1761 - RNA, 19 nt, Homo Sapiens
cagggucuccacgcugggc

SEQ ID NO: 1762 - RNA, 20 nt, Homo Sapiens
caggacccagcacgcugggc

SEQ ID NO: 1763 - RNA, 22 nt, Homo Sapiens
caggaugccaggauccuggacc

SEQ ID NO: 1764 - RNA, 21 nt, Homo Sapiens
caggaugccagcagaggcuga

SEQ ID NO: 1765 - RNA, 19 nt, Homo Sapiens
caggugggcgcgcugggcc

SEQ ID NO: 1766 - RNA, 19 nt, Homo Sapiens
cugggccuagguccuggag

SEQ ID NO: 1767 - RNA, 19 nt, Homo Sapiens
cucccucuaguccuggagg

SEQ ID NO: 1768 - RNA, 19 nt, Homo Sapiens
ggacgcgcucgcugggccg

SEQ ID NO: 1769 - RNA, 20 nt, Homo Sapiens
ggcuggcagcgcugggccga

SEQ ID NO: 1770 - RNA, 78 nt, Homo Sapiens
ccaaccacauggcacaucgggcuauuugaacacggugacugucucucccagauggaucccucugugcuucuuggacgg

SEQ ID NO: 1771 - RNA, 24 nt, Homo Sapiens
uggcacaucgggcuauuugaacac

SEQ ID NO: 1772 - RNA, 21 nt, Homo Sapiens
cacauauugguuauuugaaca

SEQ ID NO: 1773 - RNA, 21 nt, Homo Sapiens
ggcccagucuggggcuauuug

SEQ ID NO: 1774 - RNA, 26 nt, Homo Sapiens
ggcagagucaagugcuauuugaacac

SEQ ID NO: 1775 - RNA, 20 nt, Homo Sapiens
ggcacuuccuaggcuauuug

SEQ ID NO: 1776 - RNA, 19 nt, Homo Sapiens
ggcccuucuguauuugaac

SEQ ID NO: 1777 - RNA, 20 nt, Homo Sapiens
uggcacaucaggaacaauuu

SEQ ID NO: 1778 - RNA, 23 nt, Homo Sapiens
uggaacccgggcuauuuuacaca

SEQ ID NO: 1779 - RNA, 24 nt, Homo Sapiens
ugccaaauuuugcaauuugaacac

SEQ ID NO: 1780 - RNA, 74 nt, Homo Sapiens
ccaaccagagcaguucgacugggccaucaaugaccgcaucaaugagaugguccacuucgaccugccagggcagg

SEQ ID NO: 1781 - RNA, 24 nt, Homo Sapiens
ugagaugguccacuucgaccugcc

SEQ ID NO: 1782 - RNA, 20 nt, Homo Sapiens
gagauggucuggucucuucg

SEQ ID NO: 1783 - RNA, 24 nt, Homo Sapiens
gaagguacccaacugcgaccugcc

SEQ ID NO: 1784 - RNA, 21 nt, Homo Sapiens
ugagguaaugguccacguuga

SEQ ID NO: 1785 - RNA, 17 nt, Homo Sapiens
ugguccacucaccuccc

SEQ ID NO: 1786 - RNA, 90 nt, Homo Sapiens
ccaagaccaacaggaugccacgcugggccgagcgacuauuuccugccaauguugcucacucgguguacguccuggaggacucuauugugg

SEQ ID NO: 1787 - RNA, 24 nt, Homo Sapiens
gcucacucgguguacguccuggag

SEQ ID NO: 1788 - RNA, 21 nt, Homo Sapiens
cacucgguguacaugcugcag

SEQ ID NO: 1789 - RNA, 20 nt, Homo Sapiens
cacuugcugggguccuggag

SEQ ID NO: 1790 - RNA, 23 nt, Homo Sapiens
cucacuucccuggaguccuggag

SEQ ID NO: 1791 - RNA, 18 nt, Homo Sapiens
cucacucggguaggaucc

SEQ ID NO: 1792 - RNA, 17 nt, Homo Sapiens
cucacucgguccuccug

SEQ ID NO: 1793 - RNA, 24 nt, Homo Sapiens
gcuccauucuguggaguccuggag

SEQ ID NO: 1794 - RNA, 25 nt, Homo Sapiens
gcucagcugagggugaguccuggag

SEQ ID NO: 1795 - RNA, 24 nt, Homo Sapiens
gcucacucggaauugcauucugga

SEQ ID NO: 1796 - RNA, 17 nt, Homo Sapiens
gcucacucguccauccu

SEQ ID NO: 1797 - RNA, 16 nt, Homo Sapiens
gcucacucgugguccu

SEQ ID NO: 1798 - RNA, 19 nt, Homo Sapiens
gcucacucggcguagccug

SEQ ID NO: 1799 - RNA, 20 nt, Homo Sapiens
gcucccuaggaguccuggag

SEQ ID NO: 1800 - RNA, 20 nt, Homo Sapiens
gcucccugggaguccuggag

SEQ ID NO: 1801 - RNA, 22 nt, Homo Sapiens
gcuuccucuggcaguccuggag

SEQ ID NO: 1802 - RNA, 22 nt, Homo Sapiens
ucauucgguguacuugccuaga

SEQ ID NO: 1803 - RNA, 72 nt, Homo Sapiens
ccaaguucauugagguaucuaaagaggcccggaagcgguuccugggcccccugcaccccuccuucaaccugg

SEQ ID NO: 1804 - RNA, 24 nt, Homo Sapiens
ugagguaucuaaagaggcccggaa

SEQ ID NO: 1805 - RNA, 19 nt, Homo Sapiens
agcuaugguaaagaggccc

SEQ ID NO: 1806 - RNA, 19 nt, Homo Sapiens
agguaucuaggaagaagcc

SEQ ID NO: 1807 - RNA, 23 nt, Homo Sapiens
agggauccaacacuggcccggaa

SEQ ID NO: 1808 - RNA, 18 nt, Homo Sapiens
gaaguaucuaaaagcgcc

SEQ ID NO: 1809 - RNA, 19 nt, Homo Sapiens
ugaagucccaaagaggccc

SEQ ID NO: 1810 - RNA, 19 nt, Homo Sapiens
ugaguuagccaagaggccc

SEQ ID NO: 1811 - RNA, 22 nt, Homo Sapiens
ugagguaucugugcaggcccgg

SEQ ID NO: 1812 - RNA, 70 nt, Homo Sapiens
ccaauggcacauggacugguguuagcaaggaagggacccuuuguuuagaacgggucagaugggccguggg

SEQ ID NO: 1813 - RNA, 24 nt, Homo Sapiens
uggcacauggacugguguuagcaa

SEQ ID NO: 1814 - RNA, 21 nt, Homo Sapiens
acaugcuuacuguguuagcaa

SEQ ID NO: 1815 - RNA, 19 nt, Homo Sapiens
auguucuggguguuagcaa

SEQ ID NO: 1816 - RNA, 21 nt, Homo Sapiens
cacauggacccuugcuaacaa

SEQ ID NO: 1817 - RNA, 19 nt, Homo Sapiens
caggaacugguguuuggaa

SEQ ID NO: 1818 - RNA, 18 nt, Homo Sapiens
cauggacuggguugggaa

SEQ ID NO: 1819 - RNA, 18 nt, Homo Sapiens
gcacauggagagguuagc

SEQ ID NO: 1820 - RNA, 24 nt, Homo Sapiens
ggcagcagagagcaguguuagcaa

SEQ ID NO: 1821 - RNA, 19 nt, Homo Sapiens
ggaauaugaaugguguuag

SEQ ID NO: 1822 - RNA, 19 nt, Homo Sapiens
ggcagauggaguguuagca

SEQ ID NO: 1823 - RNA, 18 nt, Homo Sapiens
ggcacauggguguugcaa

SEQ ID NO: 1824 - RNA, 20 nt, Homo Sapiens
uggcacaugaggaguggugu

SEQ ID NO: 1825 - RNA, 74 nt, Homo Sapiens
ccaaugggagguuuguguacagucagugaaauugaagaacauuuaugucauuaauggacuuacauagcuauugg

SEQ ID NO: 1826 - RNA, 24 nt, Homo Sapiens
ugucauuaauggacuuacauagcu

SEQ ID NO: 1827 - RNA, 20 nt, Homo Sapiens
acaguccauguugaaauuga

SEQ ID NO: 1828 - RNA, 19 nt, Homo Sapiens
agacagugcaaaauugaag

SEQ ID NO: 1829 - RNA, 20 nt, Homo Sapiens
guacagacuaagugaaauug

SEQ ID NO: 1830 - RNA, 22 nt, Homo Sapiens
guacagacaaaauugaaauuga

SEQ ID NO: 1831 - RNA, 23 nt, Homo Sapiens
gugcaucagcacuuaaauugaag

SEQ ID NO: 1832 - RNA, 19 nt, Homo Sapiens
guauacagucaguuauauu

SEQ ID NO: 1833 - RNA, 19 nt, Homo Sapiens
gugcacagucagugaacuu

SEQ ID NO: 1834 - RNA, 19 nt, Homo Sapiens
uguacagucaucaaaauga

SEQ ID NO: 1835 - RNA, 19 nt, Homo Sapiens
uguggcuacagucaggaaa

SEQ ID NO: 1836 - RNA, 19 nt, Homo Sapiens
ugugacagugucagugaaa

SEQ ID NO: 1837 - RNA, 25 nt, Homo Sapiens
uguauucacuucagugaaagggaag

SEQ ID NO: 1838 - RNA, 20 nt, Homo Sapiens
uguguacaggcagcuuaaau

SEQ ID NO: 1839 - RNA, 24 nt, Homo Sapiens
uguguuagucacuccaaauugaag

SEQ ID NO: 1840 - RNA, 18 nt, Homo Sapiens
uguguacagguaugaaau

SEQ ID NO: 1841 - RNA, 19 nt, Homo Sapiens
uguguacaguguguaaaau

SEQ ID NO: 1842 - RNA, 79 nt, Homo Sapiens
ccaccccaugauuuuagcauucauugaugauucuugugugaacguuuaauacauuugugauuauggaauuuuaacgugg

SEQ ID NO: 1843 - RNA, 24 nt, Homo Sapiens
uuagcauucauugaugauucuugu

SEQ ID NO: 1844 - RNA, 19 nt, Homo Sapiens
agcauucauuucuugauuc

SEQ ID NO: 1845 - RNA, 21 nt, Homo Sapiens
agaauucauuaagaugauucu

SEQ ID NO: 1846 - RNA, 18 nt, Homo Sapiens
agcauucaucuauaucuu

SEQ ID NO: 1847 - RNA, 20 nt, Homo Sapiens
auucauaucuugaugauucu

SEQ ID NO: 1848 - RNA, 18 nt, Homo Sapiens
auucauaaagauucuugu

SEQ ID NO: 1849 - RNA, 19 nt, Homo Sapiens
uagcauucauuagguugau

SEQ ID NO: 1850 - RNA, 23 nt, Homo Sapiens
uagcauucagugguaugguuguu

SEQ ID NO: 1851 - RNA, 24 nt, Homo Sapiens
uuagcaaauccuauugaugaucuu

SEQ ID NO: 1852 - RNA, 25 nt, Homo Sapiens
uuugcauugcucuuugaugauucuu

SEQ ID NO: 1853 - RNA, 19 nt, Homo Sapiens
uuagcauucauggaacauu

SEQ ID NO: 1854 - RNA, 22 nt, Homo Sapiens
uuagcauucauucaucuccuug

SEQ ID NO: 1855 - RNA, 24 nt, Homo Sapiens
uuugcauucauucacuauugcugu

SEQ ID NO: 1856 - RNA, 19 nt, Homo Sapiens
uuuauugaugauucuaugu

SEQ ID NO: 1857 - RNA, 67 nt, Homo Sapiens
ccaccugccgggagcaugccucugcgccacugggggauggccagggcaguaagcccguuggggaugg

SEQ ID NO: 1858 - RNA, 24 nt, Homo Sapiens
uggccagggcaguaagcccguugg

SEQ ID NO: 1859 - RNA, 19 nt, Homo Sapiens
cagggcagucagagacccg

SEQ ID NO: 1860 - RNA, 17 nt, Homo Sapiens
ccagggcagugccuguu

SEQ ID NO: 1861 - RNA, 19 nt, Homo Sapiens
ccagggcagagcccgcugg

SEQ ID NO: 1862 - RNA, 20 nt, Homo Sapiens
gccagggcaggauguagccc

SEQ ID NO: 1863 - RNA, 18 nt, Homo Sapiens
gccagggcagaagucugu

SEQ ID NO: 1864 - RNA, 19 nt, Homo Sapiens
gccagggcaggguggccgu

SEQ ID NO: 1865 - RNA, 28 nt, Homo Sapiens
ggccagggcucugaguaagcggcgucgg

SEQ ID NO: 1866 - RNA, 22 nt, Homo Sapiens
ggccagggcauacggcaagccc

SEQ ID NO: 1867 - RNA, 23 nt, Homo Sapiens
ggccgggcugcaaggcccguugg

SEQ ID NO: 1868 - RNA, 20 nt, Homo Sapiens
ggccagggcgguaggcgccg

SEQ ID NO: 1869 - RNA, 18 nt, Homo Sapiens
ggucaggcaguaaguccg

SEQ ID NO: 1870 - RNA, 21 nt, Homo Sapiens
ggccagggcaacgggccuguu

SEQ ID NO: 1871 - RNA, 18 nt, Homo Sapiens
ggccagggcuguaccguu

SEQ ID NO: 1872 - RNA, 22 nt, Homo Sapiens
ggccagggcagccugccggaug

SEQ ID NO: 1873 - RNA, 17 nt, Homo Sapiens
ugcccagggcagagccc

SEQ ID NO: 1874 - RNA, 19 nt, Homo Sapiens
uggccagggaaccagcccg

SEQ ID NO: 1875 - RNA, 18 nt, Homo Sapiens
uggccagggucagcucgu

SEQ ID NO: 1876 - RNA, 19 nt, Homo Sapiens
uggccagggaagagcacgu

SEQ ID NO: 1877 - RNA, 22 nt, Homo Sapiens
uggccugaaaagaaagcccguu

SEQ ID NO: 1878 - RNA, 21 nt, Homo Sapiens
ugcccagggcagugcucuugg

SEQ ID NO: 1879 - RNA, 23 nt, Homo Sapiens
uggccagggcaaaagccagcugg

SEQ ID NO: 1880 - RNA, 63 nt, Homo Sapiens
ccacgccuggcuaauuuuuguauuuuuaauaaagaugcagugucaccauauuggccaggcugg

SEQ ID NO: 1881 - RNA, 24 nt, Homo Sapiens
ugcagugucaccauauuggccagg

SEQ ID NO: 1882 - RNA, 21 nt, Homo Sapiens
aguuucaccauguuggccagg

SEQ ID NO: 1883 - RNA, 24 nt, Homo Sapiens
cagggucccacuauguuggccagg

SEQ ID NO: 1884 - RNA, 20 nt, Homo Sapiens
guuucaccauauuggccagg

SEQ ID NO: 1885 - RNA, 20 nt, Homo Sapiens
guuucaccauguuggccagg

SEQ ID NO: 1886 - RNA, 20 nt, Homo Sapiens
guuuuaccauguuggccagg

SEQ ID NO: 1887 - RNA, 104 nt, Homo Sapiens
ccacgggcaccuaccacggggacagcgaccugcagcuggaacgcaucaacguguacuacaaugaggccaccggcggcaguacgugccccgcgccgugcucgugg

SEQ ID NO: 1888 - RNA, 24 nt, Homo Sapiens
ugaggccaccggcggcaguacgug

SEQ ID NO: 1889 - RNA, 21 nt, Homo Sapiens
agcccaccggcgucccgcagu

SEQ ID NO: 1890 - RNA, 21 nt, Homo Sapiens
gaggccuggcagcggcggcag

SEQ ID NO: 1891 - RNA, 24 nt, Homo Sapiens
gaggccaccgucuucugucccgug

SEQ ID NO: 1892 - RNA, 21 nt, Homo Sapiens
gaggccaccgagggucggacg

SEQ ID NO: 1893 - RNA, 20 nt, Homo Sapiens
gaugccaccggcugcgcacg

SEQ ID NO: 1894 - RNA, 19 nt, Homo Sapiens
gccaccggcagccuacaug

SEQ ID NO: 1895 - RNA, 21 nt, Homo Sapiens
ggccacgggcggcggcagcac

SEQ ID NO: 1896 - RNA, 21 nt, Homo Sapiens
ugcguccacgcucggcggcag

SEQ ID NO: 1897 - RNA, 21 nt, Homo Sapiens
ugaggccacaagagucagacg

SEQ ID NO: 1898 - RNA, 75 nt, Homo Sapiens
ccacugcuucaugagcucaaaucuguuuuuucuagcuaagagaccacaggccaaagaacuaaagggcaagcaggg

SEQ ID NO: 1899 - RNA, 24 nt, Homo Sapiens
ugagcucaaaucuguuuuuucuag

SEQ ID NO: 1900 - RNA, 18 nt, Homo Sapiens
agcucucucuuuuuucua

SEQ ID NO: 1901 - RNA, 19 nt, Homo Sapiens
agcucaaauuuuuuuucua

SEQ ID NO: 1902 - RNA, 20 nt, Homo Sapiens
gagcucuauuucuguuuuuu

SEQ ID NO: 1903 - RNA, 22 nt, Homo Sapiens
gagcucaaagcugguccuuucu

SEQ ID NO: 1904 - RNA, 17 nt, Homo Sapiens
gagcuccacuguuuuuu

SEQ ID NO: 1905 - RNA, 20 nt, Homo Sapiens
ugagcucaaaucuguguguu

SEQ ID NO: 1906 - RNA, 19 nt, Homo Sapiens
uguguucaaacuguuuuuu

SEQ ID NO: 1907 - RNA, 73 nt, Homo Sapiens
ccagcuucuagaugacauagaaugacauguaaugcuaaauuucauuuuggcuuugcaagucaugaagcuuagg

SEQ ID NO: 1908 - RNA, 24 nt, Homo Sapiens
ugacauagaaugacauguaaugcu

SEQ ID NO: 1909 - RNA, 21 nt, Homo Sapiens
acauacauaugcauguaaugc

SEQ ID NO: 1910 - RNA, 21 nt, Homo Sapiens
acaagaaaugaaauguaaugc

SEQ ID NO: 1911 - RNA, 21 nt, Homo Sapiens
acauagaauuagacauauaau

SEQ ID NO: 1912 - RNA, 21 nt, Homo Sapiens
acaagaaugacaggugaugcu

SEQ ID NO: 1913 - RNA, 17 nt, Homo Sapiens
cauagaaugauuuaaug

SEQ ID NO: 1914 - RNA, 17 nt, Homo Sapiens
cauaaauguguaaugcu

SEQ ID NO: 1915 - RNA, 26 nt, Homo Sapiens
gagauaggaaaugacaugucaaaaug

SEQ ID NO: 1916 - RNA, 20 nt, Homo Sapiens
gaaauagagaaaugacaugu

SEQ ID NO: 1917 - RNA, 21 nt, Homo Sapiens
gacauagaauuaccuuugaau

SEQ ID NO: 1918 - RNA, 19 nt, Homo Sapiens
gacauagaaucaucugaaa

SEQ ID NO: 1919 - RNA, 19 nt, Homo Sapiens
gacauagaauuaaauauaa

SEQ ID NO: 1920 - RNA, 23 nt, Homo Sapiens
ugauauacaauaccauguaaugc

SEQ ID NO: 1921 - RNA, 23 nt, Homo Sapiens
ugaaauaaacuacauguaaugcu

SEQ ID NO: 1922 - RNA, 71 nt, Homo Sapiens
ccaggaucaggaggaccccgaggaguucuacgugcugagcgagaccaccuuggcccagccccagagccugg

SEQ ID NO: 1923 - RNA, 24 nt, Homo Sapiens
ucaggaggaccccgaggaguucua

SEQ ID NO: 1924 - RNA, 18 nt, Homo Sapiens
aggaccccgacagcuucu

SEQ ID NO: 1925 - RNA, 22 nt, Homo Sapiens
agaaggaaccccgaggacuucu

SEQ ID NO: 1926 - RNA, 19 nt, Homo Sapiens
aggacgacggcccgaggag

SEQ ID NO: 1927 - RNA, 22 nt, Homo Sapiens
aggaggcgcugcugaggaguuc

SEQ ID NO: 1928 - RNA, 21 nt, Homo Sapiens
aggaggaccgagcagcauucu

SEQ ID NO: 1929 - RNA, 19 nt, Homo Sapiens
aggagggccuggaguucua

SEQ ID NO: 1930 - RNA, 18 nt, Homo Sapiens
cagugaggccgaggaguu

SEQ ID NO: 1931 - RNA, 23 nt, Homo Sapiens
caguaguugucccugaggaguuc

SEQ ID NO: 1932 - RNA, 19 nt, Homo Sapiens
caggaggacuccuuagagg

SEQ ID NO: 1933 - RNA, 19 nt, Homo Sapiens
caggaggaccgccaggggu

SEQ ID NO: 1934 - RNA, 18 nt, Homo Sapiens
caagaggaccccaggguu

SEQ ID NO: 1935 - RNA, 20 nt, Homo Sapiens
ggagcccgaccccgaggcgu

SEQ ID NO: 1936 - RNA, 19 nt, Homo Sapiens
ggaggacccggacccggag

SEQ ID NO: 1937 - RNA, 17 nt, Homo Sapiens
ggaggaccccaggauuc

SEQ ID NO: 1938 - RNA, 20 nt, Homo Sapiens
ggaggacccaagcaguccua

SEQ ID NO: 1939 - RNA, 23 nt, Homo Sapiens
ucagagaggacccccagaggugu

SEQ ID NO: 1940 - RNA, 24 nt, Homo Sapiens
ucgggaaggaccccggggcgcuuc

SEQ ID NO: 1941 - RNA, 23 nt, Homo Sapiens
ucaggagagccagcccgaggagu

SEQ ID NO: 1942 - RNA, 22 nt, Homo Sapiens
ucaggaggacuccgguggcguu

SEQ ID NO: 1943 - RNA, 19 nt, Homo Sapiens
ucaggaggaccuccgggag

SEQ ID NO: 1944 - RNA, 22 nt, Homo Sapiens
ucaggaggauccgggcggggag

SEQ ID NO: 1945 - RNA, 19 nt, Homo Sapiens
ucaggaggaggaagaggag

SEQ ID NO: 1946 - RNA, 22 nt, Homo Sapiens
ucaggaggacuugaggguacua

SEQ ID NO: 1947 - RNA, 90 nt, Homo Sapiens
ccaggccgggccaccgccggcccccugggcuguccgcgggagccgacugccugaacagcuuuaccgccggggugccuggcuucgugcugg

SEQ ID NO: 1948 - RNA, 24 nt, Homo Sapiens
aacagcuuuaccgccggggugccu

SEQ ID NO: 1949 - RNA, 23 nt, Homo Sapiens
aacagcuuugucaagccugggug

SEQ ID NO: 1950 - RNA, 20 nt, Homo Sapiens
acagcuuuagccgacugugu

SEQ ID NO: 1951 - RNA, 20 nt, Homo Sapiens
acugcucacucccggggugc

SEQ ID NO: 1952 - RNA, 24 nt, Homo Sapiens
cagcuuuacccagagcagagggug

SEQ ID NO: 1953 - RNA, 21 nt, Homo Sapiens
gcuucuccucucggggugccu

SEQ ID NO: 1954 - RNA, 77 nt, Homo Sapiens
ccaucccccagcuggcauacuguguagugcaguuuuuaggaaagaggaccgcacccucagggaaccaguggugaugg

SEQ ID NO: 1955 - RNA, 24 nt, Homo Sapiens
uggcauacuguguagugcaguuuu

SEQ ID NO: 1956 - RNA, 19 nt, Homo Sapiens
cauacugugauggugucag

SEQ ID NO: 1957 - RNA, 21 nt, Homo Sapiens
cauaaacuguccugcaguuuu

SEQ ID NO: 1958 - RNA, 20 nt, Homo Sapiens
gcauacaccugguagugcag

SEQ ID NO: 1959 - RNA, 21 nt, Homo Sapiens
gccuacaguaggagugcaguu

SEQ ID NO: 1960 - RNA, 20 nt, Homo Sapiens
gccuccuguguagugagauu

SEQ ID NO: 1961 - RNA, 22 nt, Homo Sapiens
gcagacuguguagugggguuuu

SEQ ID NO: 1962 - RNA, 23 nt, Homo Sapiens
ggcagacauggcagugcaguuuu

SEQ ID NO: 1963 - RNA, 21 nt, Homo Sapiens
ugccaugaccuuuguagugca

SEQ ID NO: 1964 - RNA, 18 nt, Homo Sapiens
uggcauacugguucaguu

SEQ ID NO: 1965 - RNA, 22 nt, Homo Sapiens
uggcacugggaacugcaguuuu

SEQ ID NO: 1966 - RNA, 23 nt, Homo Sapiens
uggcauguguucacugcaguuuu

SEQ ID NO: 1967 - RNA, 60 nt, Homo Sapiens
ccaugacacaguucugucuuggccagggaccuggcugguggagagguggaaguugcaugg

SEQ ID NO: 1968 - RNA, 24 nt, Homo Sapiens
ugacacaguucugucuuggccagg

SEQ ID NO: 1969 - RNA, 22 nt, Homo Sapiens
acacaguuccuggcucgggcag

SEQ ID NO: 1970 - RNA, 23 nt, Homo Sapiens
acacaguucugaggccuggcagg

SEQ ID NO: 1971 - RNA, 23 nt, Homo Sapiens
acagagcuguggucuuggccugg

SEQ ID NO: 1972 - RNA, 20 nt, Homo Sapiens
acagguuucuuucuuggcca

SEQ ID NO: 1973 - RNA, 21 nt, Homo Sapiens
acacuacucggcuuggccagg

SEQ ID NO: 1974 - RNA, 20 nt, Homo Sapiens
acaguucuguccuucucagg

SEQ ID NO: 1975 - RNA, 20 nt, Homo Sapiens
cacaguucuagcugggacag

SEQ ID NO: 1976 - RNA, 22 nt, Homo Sapiens
caguaaugccuucuuggccagg

SEQ ID NO: 1977 - RNA, 25 nt, Homo Sapiens
gacaaagggaucuuccuuggccagg

SEQ ID NO: 1978 - RNA, 25 nt, Homo Sapiens
gacacauuucacuguguuggccagg

SEQ ID NO: 1979 - RNA, 21 nt, Homo Sapiens
gacaaaggcugucuuggcaag

SEQ ID NO: 1980 - RNA, 22 nt, Homo Sapiens
gauagaguuguccuuggccagg

SEQ ID NO: 1981 - RNA, 25 nt, Homo Sapiens
uggcccauuccugcacuuggccagg

SEQ ID NO: 1982 - RNA, 21 nt, Homo Sapiens
ugaaacaggcugucuuggcca

SEQ ID NO: 1983 - RNA, 63 nt, Homo Sapiens
ccauggaguagauuacagcguguuggacaaggacauucccccgcgugaaggcacacuccaugg

SEQ ID NO: 1984 - RNA, 24 nt, Homo Sapiens
uggaguagauuacagcguguugga

SEQ ID NO: 1985 - RNA, 19 nt, Homo Sapiens
aguagauuagaguguguug

SEQ ID NO: 1986 - RNA, 19 nt, Homo Sapiens
ggaguagauuuauuacagc

SEQ ID NO: 1987 - RNA, 22 nt, Homo Sapiens
ggaguagaugcagagagcuugg

SEQ ID NO: 1988 - RNA, 24 nt, Homo Sapiens
uggagcucagauuacagggagcug

SEQ ID NO: 1989 - RNA, 22 nt, Homo Sapiens
uguagugagauuacaggcgagu

SEQ ID NO: 1990 - RNA, 18 nt, Homo Sapiens
uggaguagaagagcugug

SEQ ID NO: 1991 - RNA, 18 nt, Homo Sapiens
uggaaaaugacagcgugu

SEQ ID NO: 1992 - RNA, 91 nt, Homo Sapiens
cccaauuaacaucgaggucucagcaaacaauuaccacauuuaacauauauggaguuaaaguagauuggauuugcugaaaaucggugcuggg

SEQ ID NO: 1993 - RNA, 24 nt, Homo Sapiens
ucucagcaaacaauuaccacauuu

SEQ ID NO: 1994 - RNA, 19 nt, Homo Sapiens
agcaacaauuaccauuuuu

SEQ ID NO: 1995 - RNA, 23 nt, Homo Sapiens
cagcaauuuaacaguuaccacau

SEQ ID NO: 1996 - RNA, 24 nt, Homo Sapiens
caccaaaaaaaucaaaccacauuu

SEQ ID NO: 1997 - RNA, 19 nt, Homo Sapiens
cucaagcaaacaaucaaca

SEQ ID NO: 1998 - RNA, 26 nt, Homo Sapiens
cuaaccaauuacauuuaaccacauuu

SEQ ID NO: 1999 - RNA, 25 nt, Homo Sapiens
cucagcaaagauaauuucagcauuu

SEQ ID NO: 2000 - RNA, 19 nt, Homo Sapiens
cugaguaauaaauuaccac

SEQ ID NO: 2001 - RNA, 17 nt, Homo Sapiens
cucagcaaaucaccaca

SEQ ID NO: 2002 - RNA, 18 nt, Homo Sapiens
cucagcaaagacaccaca

SEQ ID NO: 2003 - RNA, 23 nt, Homo Sapiens
ucagcaaacaggaugcucacauu

SEQ ID NO: 2004 - RNA, 22 nt, Homo Sapiens
ucugcaaacaauauauacacau

SEQ ID NO: 2005 - RNA, 20 nt, Homo Sapiens
ucagaaaugcuuaccacauu

SEQ ID NO: 2006 - RNA, 18 nt, Homo Sapiens
ucucagcaaauuccacau

SEQ ID NO: 2007 - RNA, 22 nt, Homo Sapiens
ucucagcaaauuaugacaucau

SEQ ID NO: 2008 - RNA, 71 nt, Homo Sapiens
cccaggaugaguucuaccgcagcggcugggcccugaacaugaaggagcugaagcugcugcagaccaucggg

SEQ ID NO: 2009 - RNA, 24 nt, Homo Sapiens
ugaguucuaccgcagcggcugggc

SEQ ID NO: 2010 - RNA, 25 nt, Homo Sapiens
agucucuucgcaggugcggcugggc

SEQ ID NO: 2011 - RNA, 18 nt, Homo Sapiens
guucggccggcggcuggg

SEQ ID NO: 2012 - RNA, 24 nt, Homo Sapiens
uggguucggcugccagcagcggcu

SEQ ID NO: 2013 - RNA, 24 nt, Homo Sapiens
ugagugugacacagccggcugggc

SEQ ID NO: 2014 - RNA, 22 nt, Homo Sapiens
ugaguucuacaagcguugcugg

SEQ ID NO: 2015 - RNA, 17 nt, Homo Sapiens
ugaggcuaccgcagggc

SEQ ID NO: 2016 - RNA, 20 nt, Homo Sapiens
uguggucggccgcagcggcu

SEQ ID NO: 2017 - RNA, 21 nt, Homo Sapiens
ugagaacaauggcagcggcug

SEQ ID NO: 2018 - RNA, 19 nt, Homo Sapiens
ugaguucuacaggggcugg

SEQ ID NO: 2019 - RNA, 22 nt, Homo Sapiens
uucugccuuccugcggcugggc

SEQ ID NO: 2020 - RNA, 67 nt, Homo Sapiens
ccccaucuaaacuggagaagcccccaacacuuuuaagcuauguggaggggugggaguuugggagggg

SEQ ID NO: 2021 - RNA, 24 nt, Homo Sapiens
ucuaaacuggagaagcccccaaca

SEQ ID NO: 2022 - RNA, 19 nt, Homo Sapiens
aaacuggagacagcagcca

SEQ ID NO: 2023 - RNA, 19 nt, Homo Sapiens
aaaaagcagagcccccaac

SEQ ID NO: 2024 - RNA, 17 nt, Homo Sapiens
aaacaggagcccccaac

SEQ ID NO: 2025 - RNA, 19 nt, Homo Sapiens
aacuggagauagccuucaa

SEQ ID NO: 2026 - RNA, 24 nt, Homo Sapiens
aacugcagaaacucugcccccaac

SEQ ID NO: 2027 - RNA, 18 nt, Homo Sapiens
aacagggaagcccccaac

SEQ ID NO: 2028 - RNA, 19 nt, Homo Sapiens
aagugcagagcccccaaca

SEQ ID NO: 2029 - RNA, 20 nt, Homo Sapiens
aaguggccaggcccccaaca

SEQ ID NO: 2030 - RNA, 20 nt, Homo Sapiens
acugggcagccgcccccaac

SEQ ID NO: 2031 - RNA, 20 nt, Homo Sapiens
acuggcugaagcccccacca

SEQ ID NO: 2032 - RNA, 18 nt, Homo Sapiens
cuaaacuggagaccucca

SEQ ID NO: 2033 - RNA, 20 nt, Homo Sapiens
cuagaccgggaagcccccaa

SEQ ID NO: 2034 - RNA, 20 nt, Homo Sapiens
uaagacuggaaagcccccaa

SEQ ID NO: 2035 - RNA, 24 nt, Homo Sapiens
uaaacuggaaaguuucacccccaa

SEQ ID NO: 2036 - RNA, 18 nt, Homo Sapiens
uaaaaggaaagcccccaa

SEQ ID NO: 2037 - RNA, 22 nt, Homo Sapiens
ucuguacuugagagaagccccc

SEQ ID NO: 2038 - RNA, 22 nt, Homo Sapiens
ucuaaacuggaaggacaggccc

SEQ ID NO: 2039 - RNA, 23 nt, Homo Sapiens
uccacacagggaaacccccaaca

SEQ ID NO: 2040 - RNA, 65 nt, Homo Sapiens
ccccuucccauccccccacccgccugcccaugggccaguccuaggagcagcuggggaugaagggg

SEQ ID NO: 2041 - RNA, 24 nt, Homo Sapiens
uaggagcagcuggggaugaagggg

SEQ ID NO: 2042 - RNA, 20 nt, Homo Sapiens
agcagcugggguauuuaggg

SEQ ID NO: 2043 - RNA, 20 nt, Homo Sapiens
agcagcuggagauagcaggg

SEQ ID NO: 2044 - RNA, 19 nt, Homo Sapiens
  misc_feature (10)..(10): n is a, c, g or u
agcagcuggnuaugugggg

SEQ ID NO: 2045 - RNA, 19 nt, Homo Sapiens
agcagcugggauggugggg

SEQ ID NO: 2046 - RNA, 21 nt, Homo Sapiens
aggcagcagcugggggagggg

SEQ ID NO: 2047 - RNA, 24 nt, Homo Sapiens
aggaaggcaguucaggaugaaggg

SEQ ID NO: 2048 - RNA, 20 nt, Homo Sapiens
aggaagcagcugggggaagg

SEQ ID NO: 2049 - RNA, 23 nt, Homo Sapiens
aggagacaggccggggaugaagg

SEQ ID NO: 2050 - RNA, 21 nt, Homo Sapiens
agggcauggugaggaugaagg

SEQ ID NO: 2051 - RNA, 23 nt, Homo Sapiens
aggaccagugcuggggaugcagg

SEQ ID NO: 2052 - RNA, 26 nt, Homo Sapiens
agcagcagcuggaggcggugaacggg

SEQ ID NO: 2053 - RNA, 23 nt, Homo Sapiens
aggagcagcugggaacggaaugg

SEQ ID NO: 2054 - RNA, 17 nt, Homo Sapiens
agggcagcugggaggaa

SEQ ID NO: 2055 - RNA, 19 nt, Homo Sapiens
aggaacagcuggggcagaa

SEQ ID NO: 2056 - RNA, 17 nt, Homo Sapiens
aggagcagcggggugaa

SEQ ID NO: 2057 - RNA, 19 nt, Homo Sapiens
agaagcagcuggggguaag

SEQ ID NO: 2058 - RNA, 20 nt, Homo Sapiens
agggcagcuggggcuggagg

SEQ ID NO: 2059 - RNA, 20 nt, Homo Sapiens
aggagcguuggggaugaagg

SEQ ID NO: 2060 - RNA, 21 nt, Homo Sapiens
aggacagcuggggaagagggg

SEQ ID NO: 2061 - RNA, 22 nt, Homo Sapiens
aggcggagcuggggagggaggg

SEQ ID NO: 2062 - RNA, 22 nt, Homo Sapiens
agggcagcuggggcugaggcgg

SEQ ID NO: 2063 - RNA, 20 nt, Homo Sapiens
aggagcagcucgugaagggg

SEQ ID NO: 2064 - RNA, 23 nt, Homo Sapiens
aggggcagcugggaaggaggggg

SEQ ID NO: 2065 - RNA, 19 nt, Homo Sapiens
cccuccccccaccccacug

SEQ ID NO: 2066 - RNA, 21 nt, Homo Sapiens
cccuccccccacccggcagcc

SEQ ID NO: 2067 - RNA, 18 nt, Homo Sapiens
ccccuccccccacccccu

SEQ ID NO: 2068 - RNA, 19 nt, Homo Sapiens
ccccuccccccaccccccu

SEQ ID NO: 2069 - RNA, 22 nt, Homo Sapiens
cccaccccccaccccccacccc

SEQ ID NO: 2070 - RNA, 21 nt, Homo Sapiens
cccauccccagccuccugccc

SEQ ID NO: 2071 - RNA, 22 nt, Homo Sapiens
cccauccccccagcccaggccc

SEQ ID NO: 2072 - RNA, 21 nt, Homo Sapiens
ccccuccccccaccccugccc

SEQ ID NO: 2073 - RNA, 25 nt, Homo Sapiens
gagcagcuguggaauuaggaagggg

SEQ ID NO: 2074 - RNA, 19 nt, Homo Sapiens
gagcagcuggaagugaagg

SEQ ID NO: 2075 - RNA, 19 nt, Homo Sapiens
gagcagcugggcaggaggg

SEQ ID NO: 2076 - RNA, 17 nt, Homo Sapiens
gagcagcugugugcagg

SEQ ID NO: 2077 - RNA, 20 nt, Homo Sapiens
gagcagcuggcggugugggg

SEQ ID NO: 2078 - RNA, 21 nt, Homo Sapiens
gagcagcuggagauggagugg

SEQ ID NO: 2079 - RNA, 21 nt, Homo Sapiens
gagcagcugggaguguggggg

SEQ ID NO: 2080 - RNA, 21 nt, Homo Sapiens
gagcagggugggaugaagggg

SEQ ID NO: 2081 - RNA, 18 nt, Homo Sapiens
gcagcugggaugaugggg

SEQ ID NO: 2082 - RNA, 28 nt, Homo Sapiens
ggagacacagcuggggaugaggaagggg

SEQ ID NO: 2083 - RNA, 25 nt, Homo Sapiens
ggagcuggagcuggggaugcagagg

SEQ ID NO: 2084 - RNA, 23 nt, Homo Sapiens
ggagcgggguagggaugaagcgg

SEQ ID NO: 2085 - RNA, 24 nt, Homo Sapiens
ggagcagcugccucuagggaugaa

SEQ ID NO: 2086 - RNA, 24 nt, Homo Sapiens
ggagcagcugcugcgaggaagcgg

SEQ ID NO: 2087 - RNA, 22 nt, Homo Sapiens
ggugaagcgggagggaugaagg

SEQ ID NO: 2088 - RNA, 22 nt, Homo Sapiens
ggagcggguuggugaugaaggg

SEQ ID NO: 2089 - RNA, 19 nt, Homo Sapiens
ggggcagcugggccugaag

SEQ ID NO: 2090 - RNA, 21 nt, Homo Sapiens
ggagcagcuggucaggauggg

SEQ ID NO: 2091 - RNA, 21 nt, Homo Sapiens
ggcgcagcugggugggaaggg

SEQ ID NO: 2092 - RNA, 21 nt, Homo Sapiens
ggagcagcugggguggugggg

SEQ ID NO: 2093 - RNA, 23 nt, Homo Sapiens
uaggaagaggcagcugggaauga

SEQ ID NO: 2094 - RNA, 23 nt, Homo Sapiens
uaggagcagauguggagacaggg

SEQ ID NO: 2095 - RNA, 22 nt, Homo Sapiens
uagaaccagagguggaugaagg

SEQ ID NO: 2096 - RNA, 20 nt, Homo Sapiens
uagaggcagggggaugaagg

SEQ ID NO: 2097 - RNA, 23 nt, Homo Sapiens
uaggagcagaaggugauggaggg

SEQ ID NO: 2098 - RNA, 22 nt, Homo Sapiens
ucccauucccugcccacccgcc

SEQ ID NO: 2099 - RNA, 26 nt, Homo Sapiens
ucccaucccagccccagcccuugccc

SEQ ID NO: 2100 - RNA, 21 nt, Homo Sapiens
ucccaucccuucccacccgcc

SEQ ID NO: 2101 - RNA, 19 nt, Homo Sapiens
ucccaucccccaaaccacc

SEQ ID NO: 2102 - RNA, 19 nt, Homo Sapiens
ucccugcaccccacccgcc

SEQ ID NO: 2103 - RNA, 20 nt, Homo Sapiens
uccccuccccccacccggcu

SEQ ID NO: 2104 - RNA, 19 nt, Homo Sapiens
ucccacccaacccgccugc

SEQ ID NO: 2105 - RNA, 19 nt, Homo Sapiens
ucccaccccccaccccugc

SEQ ID NO: 2106 - RNA, 22 nt, Homo Sapiens
ucccaccucccacccgcccgcc

SEQ ID NO: 2107 - RNA, 22 nt, Homo Sapiens
ucccucccccacccgccucccc

SEQ ID NO: 2108 - RNA, 23 nt, Homo Sapiens
ucccauacccccaccccaugccc

SEQ ID NO: 2109 - RNA, 23 nt, Homo Sapiens
ucccaucccgccucccccucccc

SEQ ID NO: 2110 - RNA, 19 nt, Homo Sapiens
uccccccaccccccaugcc

SEQ ID NO: 2111 - RNA, 19 nt, Homo Sapiens
uccccccaccccacucccc

SEQ ID NO: 2112 - RNA, 68 nt, Homo Sapiens
cccggcagcaccccuagcaaauaggucuguaucaaagauucuguacagcugguuuugggggugaaggg

SEQ ID NO: 2113 - RNA, 23 nt, Homo Sapiens
cagcugguuuugggggugaaggg

SEQ ID NO: 2114 - RNA, 20 nt, Homo Sapiens
agcuauuuugggggugcaag

SEQ ID NO: 2115 - RNA, 23 nt, Homo Sapiens
cagguggguuuggcuggggguga

SEQ ID NO: 2116 - RNA, 25 nt, Homo Sapiens
cagcugguuguucugggguucaggg

SEQ ID NO: 2117 - RNA, 19 nt, Homo Sapiens
cagcugguuugggggcgug

SEQ ID NO: 2118 - RNA, 20 nt, Homo Sapiens
cagcaggacuuggggugaag

SEQ ID NO: 2119 - RNA, 21 nt, Homo Sapiens
cagcugguucucagagugcag

SEQ ID NO: 2120 - RNA, 21 nt, Homo Sapiens
cagcuuuuuuugggggguagg

SEQ ID NO: 2121 - RNA, 22 nt, Homo Sapiens
cagcaggugugggggugagggg

SEQ ID NO: 2122 - RNA, 20 nt, Homo Sapiens
cugguuuuggcagauaaggg

SEQ ID NO: 2123 - RNA, 19 nt, Homo Sapiens
gcuggguuuggggguuaag

SEQ ID NO: 2124 - RNA, 21 nt, Homo Sapiens
gguuuaauugggggugaaagg

SEQ ID NO: 2125 - RNA, 71 nt, Homo Sapiens
cccggcccggaauggaaugggauucacgcgacugcaccaggugggcaauuuguugaucucagggcacgugg

SEQ ID NO: 2126 - RNA, 24 nt, Homo Sapiens
uggaaugggauucacgcgacugca

SEQ ID NO: 2127 - RNA, 18 nt, Homo Sapiens
augggauucugcuacugc

SEQ ID NO: 2128 - RNA, 22 nt, Homo Sapiens
gaaugggauaaugcaggcgacu

SEQ ID NO: 2129 - RNA, 21 nt, Homo Sapiens
gggaugcgagcgcgcgacugc

SEQ ID NO: 2130 - RNA, 22 nt, Homo Sapiens
uggaaugggcacgcugggcugc

SEQ ID NO: 2131 - RNA, 19 nt, Homo Sapiens
uggaaugggacaggccugc

SEQ ID NO: 2132 - RNA, 68 nt, Homo Sapiens
cccggccucguugcccccuggcgacccucagcucaucgcuaucaucguggggcagcucaagagcaggg

SEQ ID NO: 2133 - RNA, 24 nt, Homo Sapiens
uaucaucguggggcagcucaagag

SEQ ID NO: 2134 - RNA, 21 nt, Homo Sapiens
caucgugggugcaggcaggag

SEQ ID NO: 2135 - RNA, 18 nt, Homo Sapiens
cauguggacagcucaaga

SEQ ID NO: 2136 - RNA, 19 nt, Homo Sapiens
uaucucuguggggcaguca

SEQ ID NO: 2137 - RNA, 21 nt, Homo Sapiens
uaucaucguauaucagcuuaa

SEQ ID NO: 2138 - RNA, 21 nt, Homo Sapiens
ucagcugggcacagcucaaga

SEQ ID NO: 2139 - RNA, 22 nt, Homo Sapiens
ucaucguggggcuugaucucaa

SEQ ID NO: 2140 - RNA, 19 nt, Homo Sapiens
ucuugugggcagcuccaga

SEQ ID NO: 2141 - RNA, 68 nt, Homo Sapiens
cccggggacugagaguuaaggagaguuggaggcuuuacugggccacaggguuccuacucgccccuggg

SEQ ID NO: 2142 - RNA, 24 nt, Homo Sapiens
ugagaguuaaggagaguuggaggc

SEQ ID NO: 2143 - RNA, 20 nt, Homo Sapiens
agaguuaagggcaguagaag

SEQ ID NO: 2144 - RNA, 22 nt, Homo Sapiens
agaguuaaguuaaauuggaugc

SEQ ID NO: 2145 - RNA, 22 nt, Homo Sapiens
aguuaaaaguacuguuggaggc

SEQ ID NO: 2146 - RNA, 19 nt, Homo Sapiens
gaggguuagaggagaguug

SEQ ID NO: 2147 - RNA, 19 nt, Homo Sapiens
gagaggguaggagaguugg

SEQ ID NO: 2148 - RNA, 22 nt, Homo Sapiens
gaggaugaagaagaguuggagg

SEQ ID NO: 2149 - RNA, 19 nt, Homo Sapiens
guuaugggaaguuggaggc

SEQ ID NO: 2150 - RNA, 20 nt, Homo Sapiens
ugagauuguuaaggagaguu

SEQ ID NO: 2151 - RNA, 23 nt, Homo Sapiens
ugugauuaggggagaguuggugg

SEQ ID NO: 2152 - RNA, 24 nt, Homo Sapiens
ugggauucgggagaaguuggaggc

SEQ ID NO: 2153 - RNA, 21 nt, Homo Sapiens
ugagauaaaaggagaguagga

SEQ ID NO: 2154 - RNA, 18 nt, Homo Sapiens
ugagagaaagaguuggag

SEQ ID NO: 2155 - RNA, 20 nt, Homo Sapiens
ugagagacaaggaguuggag

SEQ ID NO: 2156 - RNA, 20 nt, Homo Sapiens
ugagagggaaaaguuggagg

SEQ ID NO: 2157 - RNA, 61 nt, Homo Sapiens
cccucauaccaacuguggacuuggaauaucagcagaguaguaggcacaguuguaaaaaggg

SEQ ID NO: 2158 - RNA, 24 nt, Homo Sapiens
uaccaacuguggacuuggaauauc

SEQ ID NO: 2159 - RNA, 20 nt, Homo Sapiens
aaaugucaacuuggaauguc

SEQ ID NO: 2160 - RNA, 22 nt, Homo Sapiens
accaccuguaacugacuuggaa

SEQ ID NO: 2161 - RNA, 22 nt, Homo Sapiens
accaucuuugggggacuuggaa

SEQ ID NO: 2162 - RNA, 17 nt, Homo Sapiens
accaaguugacuuggaa

SEQ ID NO: 2163 - RNA, 17 nt, Homo Sapiens
accaacuguggauggaa

SEQ ID NO: 2164 - RNA, 22 nt, Homo Sapiens
accaacuguuuaccugacuauc

SEQ ID NO: 2165 - RNA, 19 nt, Homo Sapiens
caacuguggaacguggcau

SEQ ID NO: 2166 - RNA, 21 nt, Homo Sapiens
cagcuauggaagcuuggaaua

SEQ ID NO: 2167 - RNA, 17 nt, Homo Sapiens
ccaacuguguccggaau

SEQ ID NO: 2168 - RNA, 21 nt, Homo Sapiens
ccaacuguggaaaagaaauau

SEQ ID NO: 2169 - RNA, 16 nt, Homo Sapiens
uaccaacugggaggaa

SEQ ID NO: 2170 - RNA, 64 nt, Homo Sapiens
cccuggcagacuucacaccucauugcuuuacccccugggccuggggaaaugucuguacuuuggg

SEQ ID NO: 2171 - RNA, 24 nt, Homo Sapiens
uggcagacuucacaccucauugcu

SEQ ID NO: 2172 - RNA, 19 nt, Homo Sapiens
caaacuucacacaccacug

SEQ ID NO: 2173 - RNA, 18 nt, Homo Sapiens
caggcuccaccucauugc

SEQ ID NO: 2174 - RNA, 17 nt, Homo Sapiens
gcauacuucacacauug

SEQ ID NO: 2175 - RNA, 19 nt, Homo Sapiens
ggcagcugcucacaccuca

SEQ ID NO: 2176 - RNA, 26 nt, Homo Sapiens
ggcaaaauucccuacaccucauuucu

SEQ ID NO: 2177 - RNA, 20 nt, Homo Sapiens
ggcaacuucacacacauagc

SEQ ID NO: 2178 - RNA, 19 nt, Homo Sapiens
uggcuacucccacaccuca

SEQ ID NO: 2179 - RNA, 20 nt, Homo Sapiens
uggcagacuccacucgcuca

SEQ ID NO: 2180 - RNA, 19 nt, Homo Sapiens
uggcagcgaccacaccuca

SEQ ID NO: 2181 - RNA, 21 nt, Homo Sapiens
uggcagacuuuccuccuuucu

SEQ ID NO: 2182 - RNA, 97 nt, Homo Sapiens
ccgccccgugccccgccgcgcccccugcgggggcgaggucgggccuggcgcugcgggccugucgcccucggcggggggugcgggugcggacgggcgg

SEQ ID NO: 2183 - RNA, 24 nt, Homo Sapiens
ugucgcccucggcggggggugcgg

SEQ ID NO: 2184 - RNA, 20 nt, Homo Sapiens
cccucggcgguccgguccgg

SEQ ID NO: 2185 - RNA, 19 nt, Homo Sapiens
cccacggcggggguggcgg

SEQ ID NO: 2186 - RNA, 19 nt, Homo Sapiens
ccuuggcgggggggugggg

SEQ ID NO: 2187 - RNA, 22 nt, Homo Sapiens
cgcgcgcggcgggggcgcgcgg

SEQ ID NO: 2188 - RNA, 20 nt, Homo Sapiens
cgcccgggcggggggcacgg

SEQ ID NO: 2189 - RNA, 19 nt, Homo Sapiens
gcucucgccuggggggugc

SEQ ID NO: 2190 - RNA, 19 nt, Homo Sapiens
gccaacggcggggggcgcg

SEQ ID NO: 2191 - RNA, 18 nt, Homo Sapiens
gccagcggcggggugcgg

SEQ ID NO: 2192 - RNA, 19 nt, Homo Sapiens
gcccccuggaggggugcgg

SEQ ID NO: 2193 - RNA, 25 nt, Homo Sapiens
uguugccucugggauuggggggugc

SEQ ID NO: 2194 - RNA, 63 nt, Homo Sapiens
ccgcgagaagacguggaacaucucguucgcgggcugcggcuuccucggcgucuacuacgucgg

SEQ ID NO: 2195 - RNA, 24 nt, Homo Sapiens
ugcggcuuccucggcgucuacuac

SEQ ID NO: 2196 - RNA, 17 nt, Homo Sapiens
cggcuuccucccgcuac

SEQ ID NO: 2197 - RNA, 20 nt, Homo Sapiens
gccgcguccguucggcgucu

SEQ ID NO: 2198 - RNA, 20 nt, Homo Sapiens
gcugcuccucggcgccuucu

SEQ ID NO: 2199 - RNA, 21 nt, Homo Sapiens
gcggcuuccuccggaucucua

SEQ ID NO: 2200 - RNA, 21 nt, Homo Sapiens
ggcugcuccucggcgacuccu

SEQ ID NO: 2201 - RNA, 18 nt, Homo Sapiens
ggcuccugggcgucuacu

SEQ ID NO: 2202 - RNA, 19 nt, Homo Sapiens
ggcuuccucacugccuacu

SEQ ID NO: 2203 - RNA, 19 nt, Homo Sapiens
uggggcuuccuccccaucu

SEQ ID NO: 2204 - RNA, 96 nt, Homo Sapiens
ccgcggguggaggucgauggcagcaucauggaagggggcggccagauccugagagucucuacggccuugagcugucuccuaggccuccccuugcgg

SEQ ID NO: 2205 - RNA, 24 nt, Homo Sapiens
uggcagcaucauggaagggggcgg

SEQ ID NO: 2206 - RNA, 19 nt, Homo Sapiens
agcccccuggagggggcgg

SEQ ID NO: 2207 - RNA, 20 nt, Homo Sapiens
aggaacauggaaggggacgg

SEQ ID NO: 2208 - RNA, 21 nt, Homo Sapiens
cagcaucaugguaucuggggc

SEQ ID NO: 2209 - RNA, 20 nt, Homo Sapiens
cagcauuugugagggggcgg

SEQ ID NO: 2210 - RNA, 20 nt, Homo Sapiens
gcugcacucauggaaggugg

SEQ ID NO: 2211 - RNA, 25 nt, Homo Sapiens
ggcagugcaggguggcagggggcgg

SEQ ID NO: 2212 - RNA, 24 nt, Homo Sapiens
ggcggcgagcgagggagggggcgg

SEQ ID NO: 2213 - RNA, 23 nt, Homo Sapiens
ggaagcucguuggaagggggagg

SEQ ID NO: 2214 - RNA, 17 nt, Homo Sapiens
ggcagaaauggaagggg

SEQ ID NO: 2215 - RNA, 22 nt, Homo Sapiens
ggcagcugcaaagaagggggcg

SEQ ID NO: 2216 - RNA, 18 nt, Homo Sapiens
ggcaggaggaagggggcg

SEQ ID NO: 2217 - RNA, 21 nt, Homo Sapiens
gggagcuccggaaagggggcg

SEQ ID NO: 2218 - RNA, 20 nt, Homo Sapiens
uggcaccauucucauggaag

SEQ ID NO: 2219 - RNA, 28 nt, Homo Sapiens
ugggagcaucaagugcaggagggggcgg

SEQ ID NO: 2220 - RNA, 22 nt, Homo Sapiens
uggcagcaucaucaggaugagg

SEQ ID NO: 2221 - RNA, 26 nt, Homo Sapiens
uggcaggauuaaagggaagggggugg

SEQ ID NO: 2222 - RNA, 19 nt, Homo Sapiens
uggaaggaaaauggaaggg

SEQ ID NO: 2223 - RNA, 19 nt, Homo Sapiens
uggcaacaucauggaaggg

SEQ ID NO: 2224 - RNA, 19 nt, Homo Sapiens
ugggggcaucauggugggg

SEQ ID NO: 2225 - RNA, 19 nt, Homo Sapiens
uggcagcaugucgaagggg

SEQ ID NO: 2226 - RNA, 22 nt, Homo Sapiens
uggcagcaugggaagggggagg

SEQ ID NO: 2227 - RNA, 72 nt, Homo Sapiens
ccgcuucacuggcaccauggaugccuucgugaagaucgugaggcacgagggcaccaggacccucuggagcgg

SEQ ID NO: 2228 - RNA, 24 nt, Homo Sapiens
uggcaccauggaugccuucgugaa

SEQ ID NO: 2229 - RNA, 20 nt, Homo Sapiens
accauggauaggcuucggga

SEQ ID NO: 2230 - RNA, 19 nt, Homo Sapiens
accacggaugccuucagug

SEQ ID NO: 2231 - RNA, 20 nt, Homo Sapiens
accauggauaauuucaugaa

SEQ ID NO: 2232 - RNA, 24 nt, Homo Sapiens
caacauugcggaugcccuucguga

SEQ ID NO: 2233 - RNA, 19 nt, Homo Sapiens
caccauggauguacaugaa

SEQ ID NO: 2234 - RNA, 19 nt, Homo Sapiens
ccaugcaacacuucgugaa

SEQ ID NO: 2235 - RNA, 20 nt, Homo Sapiens
gcaccagaugccuucuggaa

SEQ ID NO: 2236 - RNA, 19 nt, Homo Sapiens
ggcacaaaacauggaugcc

SEQ ID NO: 2237 - RNA, 20 nt, Homo Sapiens
ggcaccauggugaaugcuuc

SEQ ID NO: 2238 - RNA, 20 nt, Homo Sapiens
uggcaccaucgcagucuccg

SEQ ID NO: 2239 - RNA, 20 nt, Homo Sapiens
uggcgcccugggccuucgug

SEQ ID NO: 2240 - RNA, 72 nt, Homo Sapiens
ccggauggaacguacucugugcuuauaucaucacagagcuuggaugaaagagagcgagaagaguucuauagg

SEQ ID NO: 2241 - RNA, 24 nt, Homo Sapiens
ugaaagagagcgagaagaguucua

SEQ ID NO: 2242 - RNA, 26 nt, Homo Sapiens
aaagugauggcgugagaagaguucua

SEQ ID NO: 2243 - RNA, 21 nt, Homo Sapiens
aaacagaguugagaagaguuc

SEQ ID NO: 2244 - RNA, 18 nt, Homo Sapiens
aaagagagcuaaaaaguu

SEQ ID NO: 2245 - RNA, 20 nt, Homo Sapiens
aaagagaccuugaagaguuc

SEQ ID NO: 2246 - RNA, 18 nt, Homo Sapiens
aaagaagaaaagaguucu

SEQ ID NO: 2247 - RNA, 22 nt, Homo Sapiens
aaacauauggauaagaguucua

SEQ ID NO: 2248 - RNA, 24 nt, Homo Sapiens
gagagaugaggguggagaguucua

SEQ ID NO: 2249 - RNA, 20 nt, Homo Sapiens
gaaggagacgucgagaagag

SEQ ID NO: 2250 - RNA, 20 nt, Homo Sapiens
gaaagagaggggagaaaagu

SEQ ID NO: 2251 - RNA, 21 nt, Homo Sapiens
gaaagagagcaaguugaagag

SEQ ID NO: 2252 - RNA, 19 nt, Homo Sapiens
gaaagagagaaagagagag

SEQ ID NO: 2253 - RNA, 19 nt, Homo Sapiens
gaaagagagagagagagag

SEQ ID NO: 2254 - RNA, 19 nt, Homo Sapiens
gaaagagagagagauagag

SEQ ID NO: 2255 - RNA, 18 nt, Homo Sapiens
gaaagaguugagaagagu

SEQ ID NO: 2256 - RNA, 18 nt, Homo Sapiens
gagagagagcgagagagu

SEQ ID NO: 2257 - RNA, 20 nt, Homo Sapiens
gagagagagcgagcgagcuc

SEQ ID NO: 2258 - RNA, 21 nt, Homo Sapiens
gaaagagagcuguggagcucu

SEQ ID NO: 2259 - RNA, 22 nt, Homo Sapiens
ugaagggagaugggagaagagu

SEQ ID NO: 2260 - RNA, 21 nt, Homo Sapiens
ugaaagagaugggagaagguu

SEQ ID NO: 2261 - RNA, 20 nt, Homo Sapiens
ugaaagagagagauggagag

SEQ ID NO: 2262 - RNA, 27 nt, Homo Sapiens
ugaaagagagagagucauaaagauucu

SEQ ID NO: 2263 - RNA, 19 nt, Homo Sapiens
ugaaagagaauggaaagag

SEQ ID NO: 2264 - RNA, 19 nt, Homo Sapiens
ugaaagagagagacaggag

SEQ ID NO: 2265 - RNA, 23 nt, Homo Sapiens
ugaaagagagagaaaguauccua

SEQ ID NO: 2266 - RNA, 65 nt, Homo Sapiens
ccggggcgcaaugcgagcggcuggcguaggcuugguggacugucacugccaccucuccgccccgg

SEQ ID NO: 2267 - RNA, 19 nt, Homo Sapiens
ugccaccucuccgccccgg

SEQ ID NO: 2268 - RNA, 19 nt, Homo Sapiens
gccccgcucuccgccccgg

SEQ ID NO: 2269 - RNA, 21 nt, Homo Sapiens
gcccccuuccugccgccccgg

SEQ ID NO: 2270 - RNA, 19 nt, Homo Sapiens
gccaucggcuccgccccgg

SEQ ID NO: 2271 - RNA, 19 nt, Homo Sapiens
gccaccgcccuccgccccg

SEQ ID NO: 2272 - RNA, 21 nt, Homo Sapiens
ugccacgggggcucuccgccc

SEQ ID NO: 2273 - RNA, 21 nt, Homo Sapiens
uggcaccguccuccgccccgg

SEQ ID NO: 2274 - RNA, 19 nt, Homo Sapiens
ugccaccuccguacgcccc

SEQ ID NO: 2275 - RNA, 22 nt, Homo Sapiens
ugccaccucucgcgguccccgg

SEQ ID NO: 2276 - RNA, 19 nt, Homo Sapiens
ugcgcccgccccgccccgg

SEQ ID NO: 2277 - RNA, 63 nt, Homo Sapiens
ccuaacgccucggucagcaacggagcuaccuuccuggagucccccacgugcgccggggcuggg

SEQ ID NO: 2278 - RNA, 24 nt, Homo Sapiens
uaacgccucggucagcaacggagc

SEQ ID NO: 2279 - RNA, 22 nt, Homo Sapiens
aacgcacucagccagcaacgga

SEQ ID NO: 2280 - RNA, 17 nt, Homo Sapiens
aacggcgacagcaacgg

SEQ ID NO: 2281 - RNA, 20 nt, Homo Sapiens
aacgccucggguacaacuga

SEQ ID NO: 2282 - RNA, 20 nt, Homo Sapiens
acgccucggucagcggcgga

SEQ ID NO: 2283 - RNA, 21 nt, Homo Sapiens
ccucggucacagucacggggc

SEQ ID NO: 2284 - RNA, 22 nt, Homo Sapiens
cgccucggugcccaggagcgga

SEQ ID NO: 2285 - RNA, 21 nt, Homo Sapiens
cgccucggugcagugccggag

SEQ ID NO: 2286 - RNA, 16 nt, Homo Sapiens
cgccgacagcaacgga

SEQ ID NO: 2287 - RNA, 19 nt, Homo Sapiens
gccucgguccuuaacugga

SEQ ID NO: 2288 - RNA, 20 nt, Homo Sapiens
uaacgccucuggaauaagca

SEQ ID NO: 2289 - RNA, 22 nt, Homo Sapiens
uaaggcgcccgugcaacggagc

SEQ ID NO: 2290 - RNA, 60 nt, Homo Sapiens
ccuccacuacugguuguggagucccagaaggaucccgagaacagcccuguggugcuuugg

SEQ ID NO: 2291 - RNA, 24 nt, Homo Sapiens
ucccgagaacagcccuguggugcu

SEQ ID NO: 2292 - RNA, 21 nt, Homo Sapiens
cccggcccagcccuguccugc

SEQ ID NO: 2293 - RNA, 20 nt, Homo Sapiens
cccgggcagccuguggugcu

SEQ ID NO: 2294 - RNA, 24 nt, Homo Sapiens
uccccaggaggagcaccuguggug

SEQ ID NO: 2295 - RNA, 70 nt, Homo Sapiens
ccuccugacacccuucucccacucuccuaggcauucuggaccucuggguugggaucagggguaggaaugg

SEQ ID NO: 2296 - RNA, 24 nt, Homo Sapiens
ugacacccuucucccacucuccua

SEQ ID NO: 2297 - RNA, 19 nt, Homo Sapiens
acaccucuuuucucccacu

SEQ ID NO: 2298 - RNA, 22 nt, Homo Sapiens
acaccaccucucccacugcccu

SEQ ID NO: 2299 - RNA, 20 nt, Homo Sapiens
acucccuucuccucucucuc

SEQ ID NO: 2300 - RNA, 22 nt, Homo Sapiens
acacccuucugccagcuuuccu

SEQ ID NO: 2301 - RNA, 21 nt, Homo Sapiens
cacccauugugcacucuccua

SEQ ID NO: 2302 - RNA, 19 nt, Homo Sapiens
cccuucgccucccacucuc

SEQ ID NO: 2303 - RNA, 19 nt, Homo Sapiens
cccugcacagccacucucc

SEQ ID NO: 2304 - RNA, 20 nt, Homo Sapiens
cccuucuguuccacucuccu

SEQ ID NO: 2305 - RNA, 19 nt, Homo Sapiens
cccuucuccguccuuccua

SEQ ID NO: 2306 - RNA, 18 nt, Homo Sapiens
gacacccccccacucucc

SEQ ID NO: 2307 - RNA, 21 nt, Homo Sapiens
gaccccccacccccacucucc

SEQ ID NO: 2308 - RNA, 22 nt, Homo Sapiens
ugccucucucucucccacucuc

SEQ ID NO: 2309 - RNA, 21 nt, Homo Sapiens
ugacucccuuucucccacucu

SEQ ID NO: 2310 - RNA, 24 nt, Homo Sapiens
ugccucccuucuccucucucuccu

SEQ ID NO: 2311 - RNA, 21 nt, Homo Sapiens
ugacacccucccgcccucucc

SEQ ID NO: 2312 - RNA, 70 nt, Homo Sapiens
ccugaagccgaccaucugcuccgaccaggacaacuacugcgugacugugucugcuagugccggcauuggg

SEQ ID NO: 2313 - RNA, 24 nt, Homo Sapiens
gacugugucugcuagugccggcau

SEQ ID NO: 2314 - RNA, 20 nt, Homo Sapiens
cugugucuguccuccuagug

SEQ ID NO: 2315 - RNA, 22 nt, Homo Sapiens
cugugucuggcagggcgcggca

SEQ ID NO: 2316 - RNA, 24 nt, Homo Sapiens
cugugucugacauggcccuggcau

SEQ ID NO: 2317 - RNA, 24 nt, Homo Sapiens
cugugucugauacugucuuggcau

SEQ ID NO: 2318 - RNA, 19 nt, Homo Sapiens
cugaguuugcuggugcagg

SEQ ID NO: 2319 - RNA, 18 nt, Homo Sapiens
cugugucugucggcuggc

SEQ ID NO: 2320 - RNA, 21 nt, Homo Sapiens
cugugucugccuggaaggcau

SEQ ID NO: 2321 - RNA, 26 nt, Homo Sapiens
gacugugucuggccugcugucgccau

SEQ ID NO: 2322 - RNA, 23 nt, Homo Sapiens
gagugugucugcuuguccaacau

SEQ ID NO: 2323 - RNA, 20 nt, Homo Sapiens
gugucugcugagcuccggca

SEQ ID NO: 2324 - RNA, 17 nt, Homo Sapiens
guggcugggugccggca

SEQ ID NO: 2325 - RNA, 22 nt, Homo Sapiens
ugugucugcccuagauccaggc

SEQ ID NO: 2326 - RNA, 24 nt, Homo Sapiens
ugugucugcacagggccuggggca

SEQ ID NO: 2327 - RNA, 20 nt, Homo Sapiens
ugugucugcgcgucgccggc

SEQ ID NO: 2328 - RNA, 78 nt, Homo Sapiens
ccugcgcacgcgucgcagccaucuccgcgcacagugguggccaccgcgacuggugcugaagugucggcgugugccggg

SEQ ID NO: 2329 - RNA, 24 nt, Homo Sapiens
ucgcagccaucuccgcgcacagug

SEQ ID NO: 2330 - RNA, 20 nt, Homo Sapiens
agccagccggccgcgcacag

SEQ ID NO: 2331 - RNA, 23 nt, Homo Sapiens
agccaucucugagcuaaccagug

SEQ ID NO: 2332 - RNA, 19 nt, Homo Sapiens
cccucuccgcgcgcgacag

SEQ ID NO: 2333 - RNA, 24 nt, Homo Sapiens
cgccgcucacucacucgcgcacag

SEQ ID NO: 2334 - RNA, 23 nt, Homo Sapiens
cgcagccucuagcagcgcacagu

SEQ ID NO: 2335 - RNA, 23 nt, Homo Sapiens
cggagccaucuccacagcccugu

SEQ ID NO: 2336 - RNA, 19 nt, Homo Sapiens
cgcagaguucccgcgcaca

SEQ ID NO: 2337 - RNA, 20 nt, Homo Sapiens
gcaggucuucuccgcgccca

SEQ ID NO: 2338 - RNA, 22 nt, Homo Sapiens
gcggccacugucuccgcgcuca

SEQ ID NO: 2339 - RNA, 18 nt, Homo Sapiens
gcagccaucuccagccac

SEQ ID NO: 2340 - RNA, 19 nt, Homo Sapiens
gcagccaucaccacggcac

SEQ ID NO: 2341 - RNA, 20 nt, Homo Sapiens
gcagccaucagagcccagug

SEQ ID NO: 2342 - RNA, 19 nt, Homo Sapiens
ucgcaccccuucuccgcgc

SEQ ID NO: 2343 - RNA, 17 nt, Homo Sapiens
ucgccgcucuccgcgca

SEQ ID NO: 2344 - RNA, 23 nt, Homo Sapiens
ucgccggagucuccgcgcaccgu

SEQ ID NO: 2345 - RNA, 66 nt, Homo Sapiens
ccuggcaccuguguuccagcccacaucccacaugcggcucgggcuucggaacacggaguggccggg

SEQ ID NO: 2346 - RNA, 24 nt, Homo Sapiens
uggcaccuguguuccagcccacau

SEQ ID NO: 2347 - RNA, 19 nt, Homo Sapiens
cacucugugcuuccagccc

SEQ ID NO: 2348 - RNA, 21 nt, Homo Sapiens
caccugcuuuuccagcccaca

SEQ ID NO: 2349 - RNA, 20 nt, Homo Sapiens
caccuguguuccaagcccac

SEQ ID NO: 2350 - RNA, 16 nt, Homo Sapiens
caccuggccagcccac

SEQ ID NO: 2351 - RNA, 19 nt, Homo Sapiens
ccagugcuuccagcccaca

SEQ ID NO: 2352 - RNA, 19 nt, Homo Sapiens
ccucuguuccagcuccaca

SEQ ID NO: 2353 - RNA, 19 nt, Homo Sapiens
cugcuguuccagcccacau

SEQ ID NO: 2354 - RNA, 22 nt, Homo Sapiens
gcagcguguuccagacacacau

SEQ ID NO: 2355 - RNA, 20 nt, Homo Sapiens
ggcgccgcugcuccagccca

SEQ ID NO: 2356 - RNA, 21 nt, Homo Sapiens
ggcaccagagcccagcccaca

SEQ ID NO: 2357 - RNA, 21 nt, Homo Sapiens
ggcaccugugucuggccaaau

SEQ ID NO: 2358 - RNA, 19 nt, Homo Sapiens
uggcaccugaauuuuccag

SEQ ID NO: 2359 - RNA, 24 nt, Homo Sapiens
uggcaccugcuguuccccccaaau

SEQ ID NO: 2360 - RNA, 20 nt, Homo Sapiens
uggcaccugucaccagcuca

SEQ ID NO: 2361 - RNA, 20 nt, Homo Sapiens
uggcacaagugcagcccaca

SEQ ID NO: 2362 - RNA, 23 nt, Homo Sapiens
uggaaguugguuccagccaaaau

SEQ ID NO: 2363 - RNA, 67 nt, Homo Sapiens
ccuggcagacaggcgggcaaacagugagcgcccacccagaccggcugcugcgcccccuccugccagg

SEQ ID NO: 2364 - RNA, 24 nt, Homo Sapiens
uggcagacaggcgggcaaacagug

SEQ ID NO: 2365 - RNA, 22 nt, Homo Sapiens
agacaguguggcagcaaacagu

SEQ ID NO: 2366 - RNA, 21 nt, Homo Sapiens
agacagacugaacaaacagug

SEQ ID NO: 2367 - RNA, 16 nt, Homo Sapiens
cacacagggcaaacag

SEQ ID NO: 2368 - RNA, 19 nt, Homo Sapiens
gacaugaacgggcaaacag

SEQ ID NO: 2369 - RNA, 22 nt, Homo Sapiens
gcagacaggcagucugaaaaca

SEQ ID NO: 2370 - RNA, 19 nt, Homo Sapiens
gcaaacuugagggcaaaca

SEQ ID NO: 2371 - RNA, 20 nt, Homo Sapiens
gcaagcaggcgggcaggcag

SEQ ID NO: 2372 - RNA, 22 nt, Homo Sapiens
ggcgggcaggcgggcaagacag

SEQ ID NO: 2373 - RNA, 20 nt, Homo Sapiens
ggcagacagucugacagaca

SEQ ID NO: 2374 - RNA, 21 nt, Homo Sapiens
ggcagacaggcaggcaggcag

SEQ ID NO: 2375 - RNA, 21 nt, Homo Sapiens
ggcagacagggagggaggcag

SEQ ID NO: 2376 - RNA, 19 nt, Homo Sapiens
ggcagcaguggcaaacagu

SEQ ID NO: 2377 - RNA, 22 nt, Homo Sapiens
ggcagacagaaaggccaacggu

SEQ ID NO: 2378 - RNA, 21 nt, Homo Sapiens
ggcagaggcgggcacagagug

SEQ ID NO: 2379 - RNA, 23 nt, Homo Sapiens
ggcagacaggagggaagauggug

SEQ ID NO: 2380 - RNA, 19 nt, Homo Sapiens
ugggagaccgaggcgggca

SEQ ID NO: 2381 - RNA, 21 nt, Homo Sapiens
ugggaggccaaggcgggcaaa

SEQ ID NO: 2382 - RNA, 21 nt, Homo Sapiens
ugggaggcugaggcgggcaaa

SEQ ID NO: 2383 - RNA, 21 nt, Homo Sapiens
uggcagacaugcuggggaaac

SEQ ID NO: 2384 - RNA, 23 nt, Homo Sapiens
uggcagacagcgaggcaacagug

SEQ ID NO: 2385 - RNA, 23 nt, Homo Sapiens
uggaggcaggcgggccgaaccag

SEQ ID NO: 2386 - RNA, 18 nt, Homo Sapiens
uggcgaacggcgggcaaa

SEQ ID NO: 2387 - RNA, 21 nt, Homo Sapiens
uggcagacaguccagauaaca

SEQ ID NO: 2388 - RNA, 24 nt, Homo Sapiens
uggcuuagaugauggcaaacagug

SEQ ID NO: 2389 - RNA, 64 nt, Homo Sapiens
ccuuuauuaguccaccccuuggagcuagacauccuguacuuagucacggggaugguggaagagg

SEQ ID NO: 2390 - RNA, 24 nt, Homo Sapiens
uauuaguccaccccuuggagcuag

SEQ ID NO: 2391 - RNA, 18 nt, Homo Sapiens
augagucaccccuugcag

SEQ ID NO: 2392 - RNA, 22 nt, Homo Sapiens
auugguccugcccuuggaguag

SEQ ID NO: 2393 - RNA, 19 nt, Homo Sapiens
uaguccaccccucagggcu

SEQ ID NO: 2394 - RNA, 22 nt, Homo Sapiens
uauuaguccaggcaccccgugg

SEQ ID NO: 2395 - RNA, 20 nt, Homo Sapiens
uauuuccacugccuuggagc

SEQ ID NO: 2396 - RNA, 18 nt, Homo Sapiens
uauuuuucccccuuggag

SEQ ID NO: 2397 - RNA, 20 nt, Homo Sapiens
uauuugucaauccuuggagc

SEQ ID NO: 2398 - RNA, 20 nt, Homo Sapiens
uccaggccccuuggaugcua

SEQ ID NO: 2399 - RNA, 22 nt, Homo Sapiens
uuauaccaccccuuugagguag

SEQ ID NO: 2400 - RNA, 63 nt, Homo Sapiens
ccuuugcccgcaugcugaucgcgcaagaggggcugcugugcgguggcagugcuggcagcacgg

SEQ ID NO: 2401 - RNA, 24 nt, Homo Sapiens
gugcgguggcagugcuggcagcac

SEQ ID NO: 2402 - RNA, 21 nt, Homo Sapiens
cggggucagugcuggucagca

SEQ ID NO: 2403 - RNA, 9 nt, Homo Sapiens
gcagugcug

SEQ ID NO: 2404 - RNA, 22 nt, Homo Sapiens
gcgguggcaccugcugcccagc

SEQ ID NO: 2405 - RNA, 24 nt, Homo Sapiens
gcgguggcagccacgcgggcgcac

SEQ ID NO: 2406 - RNA, 24 nt, Homo Sapiens
gcgguggcaguagcagcagcagca

SEQ ID NO: 2407 - RNA, 12 nt, Homo Sapiens
gcaguggcagug

SEQ ID NO: 2408 - RNA, 17 nt, Homo Sapiens
gcgguggcaggcggcag

SEQ ID NO: 2409 - RNA, 20 nt, Homo Sapiens
gcgguggcagcggcggcggc

SEQ ID NO: 2410 - RNA, 21 nt, Homo Sapiens
gcggugacucaccuggcagca

SEQ ID NO: 2411 - RNA, 19 nt, Homo Sapiens
gguggcagugagacagcac

SEQ ID NO: 2412 - RNA, 21 nt, Homo Sapiens
gugggcguggcagugggcagc

SEQ ID NO: 2413 - RNA, 27 nt, Homo Sapiens
gugcccuggagcagagccuggcagcac

SEQ ID NO: 2414 - RNA, 24 nt, Homo Sapiens
gugcgguggcgggucugggcggca

SEQ ID NO: 2415 - RNA, 18 nt, Homo Sapiens
gugcgguggcaguauggc

SEQ ID NO: 2416 - RNA, 19 nt, Homo Sapiens
gugggugggagugcuggca

SEQ ID NO: 2417 - RNA, 18 nt, Homo Sapiens
gugcggucagugcuggca

SEQ ID NO: 2418 - RNA, 18 nt, Homo Sapiens
guggcagcugcuugaagg

SEQ ID NO: 2419 - RNA, 19 nt, Homo Sapiens
guggcaggugcuggcagca

SEQ ID NO: 2420 - RNA, 24 nt, Homo Sapiens
ugcgguggcggcggugguggcugc

SEQ ID NO: 2421 - RNA, 20 nt, Homo Sapiens
ugcgguggcuacuggagcac

SEQ ID NO: 2422 - RNA, 69 nt, Homo Sapiens
ccuuuuauaugaugaucuggagaauucugcucuuugauaacaacucaggauuuuuuugaucacguuugg

SEQ ID NO: 2423 - RNA, 24 nt, Homo Sapiens
uaugaugaucuggagaauucugcu

SEQ ID NO: 2424 - RNA, 24 nt, Homo Sapiens
augauggaauuuguggagaauucu

SEQ ID NO: 2425 - RNA, 19 nt, Homo Sapiens
augagguuggcuggagaau

SEQ ID NO: 2426 - RNA, 24 nt, Homo Sapiens
auguuaauaugcagcaauucugcu

SEQ ID NO: 2427 - RNA, 22 nt, Homo Sapiens
gauguaacuggagaauauaugc

SEQ ID NO: 2428 - RNA, 19 nt, Homo Sapiens
gaugaucugaaugauuucu

SEQ ID NO: 2429 - RNA, 21 nt, Homo Sapiens
gaugaucugcagacuugugcu

SEQ ID NO: 2430 - RNA, 22 nt, Homo Sapiens
uaugaugauaucagauucuucu

SEQ ID NO: 2431 - RNA, 18 nt, Homo Sapiens
ugaugaucugggaguccu

SEQ ID NO: 2432 - RNA, 20 nt, Homo Sapiens
ugaguucuuggaauucugcu

SEQ ID NO: 2433 - RNA, 21 nt, Homo Sapiens
uggugaucuggaaaacuugcu

SEQ ID NO: 2434 - RNA, 60 nt, Homo Sapiens
cgacccucgacugcggggcccgggcggcggcgcuagcagauccagcggaugaagcggucg

SEQ ID NO: 2435 - RNA, 24 nt, Homo Sapiens
uagcagauccagcggaugaagcgg

SEQ ID NO: 2436 - RNA, 19 nt, Homo Sapiens
agagucacaacggaugaag

SEQ ID NO: 2437 - RNA, 22 nt, Homo Sapiens
agcagugucuccggcggaugaa

SEQ ID NO: 2438 - RNA, 21 nt, Homo Sapiens
agcagauguuagccagcggau

SEQ ID NO: 2439 - RNA, 23 nt, Homo Sapiens
agaagaucugaggaggaugaagc

SEQ ID NO: 2440 - RNA, 21 nt, Homo Sapiens
cagaauccagcggcaaugaag

SEQ ID NO: 2441 - RNA, 19 nt, Homo Sapiens
cagauccagcuugggagga

SEQ ID NO: 2442 - RNA, 20 nt, Homo Sapiens
cagauccagcugccuguagc

SEQ ID NO: 2443 - RNA, 17 nt, Homo Sapiens
cagauccagcaugcaag

SEQ ID NO: 2444 - RNA, 18 nt, Homo Sapiens
cagauccaggaucacagc

SEQ ID NO: 2445 - RNA, 19 nt, Homo Sapiens
gcaguccauuggaugaagc

SEQ ID NO: 2446 - RNA, 19 nt, Homo Sapiens
gcagauccaccgaugaggc

SEQ ID NO: 2447 - RNA, 22 nt, Homo Sapiens
uaccagauccagcugcucaggc

SEQ ID NO: 2448 - RNA, 86 nt, Homo Sapiens
cgagauugagcaauaacaggucugugaugcccuuaguuguccggcccggacaacgacaggauugacagauugauagcucuuucucg

SEQ ID NO: 2449 - RNA, 24 nt, Homo Sapiens
uaacaggucugugaugcccuuagu

SEQ ID NO: 2450 - RNA, 25 nt, Homo Sapiens
aacaggcucuggcugugaugcacuu

SEQ ID NO: 2451 - RNA, 21 nt, Homo Sapiens
aacaggucugagcuacuccuu

SEQ ID NO: 2452 - RNA, 19 nt, Homo Sapiens
aagaggucaugaugcccuu

SEQ ID NO: 2453 - RNA, 20 nt, Homo Sapiens
aacaggucucuugcccucag

SEQ ID NO: 2454 - RNA, 22 nt, Homo Sapiens
acagggcucucugugaugcucu

SEQ ID NO: 2455 - RNA, 18 nt, Homo Sapiens
aggucuguggaccucagu

SEQ ID NO: 2456 - RNA, 20 nt, Homo Sapiens
caggucugugacgucacuag

SEQ ID NO: 2457 - RNA, 20 nt, Homo Sapiens
gucuaagaaggugcccuuag

SEQ ID NO: 2458 - RNA, 65 nt, Homo Sapiens
cgcagcccugcucguggguccaagagcugcuuacuucugggggcacccaugcugagggggcugcg

SEQ ID NO: 2459 - RNA, 24 nt, Homo Sapiens
gggggcacccaugcugagggggcu

SEQ ID NO: 2460 - RNA, 20 nt, Homo Sapiens
gggagccaugcugacagggc

SEQ ID NO: 2461 - RNA, 25 nt, Homo Sapiens
gggcacggucccaaggcugaggggg

SEQ ID NO: 2462 - RNA, 26 nt, Homo Sapiens
gggguugcacucagacugcugagggg

SEQ ID NO: 2463 - RNA, 27 nt, Homo Sapiens
ggugcacuccagcgaccugagggggcu

SEQ ID NO: 2464 - RNA, 21 nt, Homo Sapiens
ggggcacccgaugagccgagg

SEQ ID NO: 2465 - RNA, 19 nt, Homo Sapiens
ggggcacccgcugcugagg

SEQ ID NO: 2466 - RNA, 25 nt, Homo Sapiens
ggagcagccucggcugaggggagcu

SEQ ID NO: 2467 - RNA, 27 nt, Homo Sapiens
ggggccccaugcuggcuggcgggggcu

SEQ ID NO: 2468 - RNA, 19 nt, Homo Sapiens
gggucacccaugcuagagg

SEQ ID NO: 2469 - RNA, 25 nt, Homo Sapiens
gggggcacccauguccuuccugagg

SEQ ID NO: 2470 - RNA, 21 nt, Homo Sapiens
gggggcaccugcggcaguggg

SEQ ID NO: 2471 - RNA, 24 nt, Homo Sapiens
gggggcugcauccuggagggggcu

SEQ ID NO: 2472 - RNA, 18 nt, Homo Sapiens
gggggcacccuggagggg

SEQ ID NO: 2473 - RNA, 21 nt, Homo Sapiens
gggggcaccgaagcuaggugg

SEQ ID NO: 2474 - RNA, 24 nt, Homo Sapiens
gggggcaccccugggcagauggcu

SEQ ID NO: 2475 - RNA, 21 nt, Homo Sapiens
gggggcguccccgagggggcu

SEQ ID NO: 2476 - RNA, 24 nt, Homo Sapiens
gggggcucugacguggagggggcu

SEQ ID NO: 2477 - RNA, 131 nt, Homo Sapiens
cgcgugccccgcccgcuggagcaccugccaccgaggcgcgcguggggccacugccguggcggcggcugcccuccucacacucggcuccgcgccgccuccggccaccgugcgcucccgcguggggcgccucg

SEQ ID NO: 2478 - RNA, 24 nt, Homo Sapiens
ucacacucggcuccgcgccgccuc

SEQ ID NO: 2479 - RNA, 19 nt, Homo Sapiens
acacucggcccgcggcgcc

SEQ ID NO: 2480 - RNA, 18 nt, Homo Sapiens
acccuccuccgcgccgcc

SEQ ID NO: 2481 - RNA, 23 nt, Homo Sapiens
acucggcucgcgcaccucgccuc

SEQ ID NO: 2482 - RNA, 19 nt, Homo Sapiens
acucggcucugggucccuc

SEQ ID NO: 2483 - RNA, 28 nt, Homo Sapiens
cacagcucggggcugcuccgcgcccgcc

SEQ ID NO: 2484 - RNA, 22 nt, Homo Sapiens
cacauguccgcuccgcgcggcc

SEQ ID NO: 2485 - RNA, 20 nt, Homo Sapiens
cacucuccggcuccgcuccg

SEQ ID NO: 2486 - RNA, 22 nt, Homo Sapiens
cacacgcgcgcuccgcgccucc

SEQ ID NO: 2487 - RNA, 25 nt, Homo Sapiens
cacaccgggcaaaguccgcgccgcc

SEQ ID NO: 2488 - RNA, 20 nt, Homo Sapiens
cagacucggcucucgaaccg

SEQ ID NO: 2489 - RNA, 25 nt, Homo Sapiens
cacagcggcuccgccucugccgccu

SEQ ID NO: 2490 - RNA, 23 nt, Homo Sapiens
cacgcuugccgccucgccgccuc

SEQ ID NO: 2491 - RNA, 21 nt, Homo Sapiens
cagacuccgcugcgccgccuc

SEQ ID NO: 2492 - RNA, 22 nt, Homo Sapiens
cacugcccuccgcgcccgccuc

SEQ ID NO: 2493 - RNA, 19 nt, Homo Sapiens
cacucggcuccccgcugcc

SEQ ID NO: 2494 - RNA, 20 nt, Homo Sapiens
cacucaggccgcgccgccuc

SEQ ID NO: 2495 - RNA, 21 nt, Homo Sapiens
cggccccgccgccgccgccuc

SEQ ID NO: 2496 - RNA, 19 nt, Homo Sapiens
cgccuccgcccgccgccuc

SEQ ID NO: 2497 - RNA, 19 nt, Homo Sapiens
cggcuccgcacccggccuc

SEQ ID NO: 2498 - RNA, 20 nt, Homo Sapiens
cucgcgcucagccagcggcc

SEQ ID NO: 2499 - RNA, 21 nt, Homo Sapiens
cucggccuuccacgccgccuc

SEQ ID NO: 2500 - RNA, 21 nt, Homo Sapiens
cucggccgccgccgccgccuc

SEQ ID NO: 2501 - RNA, 24 nt, Homo Sapiens
cucggcucuccccgccgccgccuc

SEQ ID NO: 2502 - RNA, 19 nt, Homo Sapiens
cucggcucccgggcgccgc

SEQ ID NO: 2503 - RNA, 20 nt, Homo Sapiens
cugggggccgccgccgccuc

SEQ ID NO: 2504 - RNA, 21 nt, Homo Sapiens
cucggcuccccgccucgccuc

SEQ ID NO: 2505 - RNA, 20 nt, Homo Sapiens
cucggccccgcgccgcgcuc

SEQ ID NO: 2506 - RNA, 18 nt, Homo Sapiens
cucgcgcggcgccgccuc

SEQ ID NO: 2507 - RNA, 18 nt, Homo Sapiens
cucggcccccgccgccuc

SEQ ID NO: 2508 - RNA, 19 nt, Homo Sapiens
cucggcucccugcaaccuc

SEQ ID NO: 2509 - RNA, 23 nt, Homo Sapiens
ucagcgcccggccuccgcgccgc

SEQ ID NO: 2510 - RNA, 27 nt, Homo Sapiens
ucagccucgggcucccgcgccgcgcuc

SEQ ID NO: 2511 - RNA, 26 nt, Homo Sapiens
ucccacuccucugccgccgccgccuc

SEQ ID NO: 2512 - RNA, 23 nt, Homo Sapiens
ucaccuggcuccuccgccgccuc

SEQ ID NO: 2513 - RNA, 25 nt, Homo Sapiens
ucagacgcggcuccgcuccggccuc

SEQ ID NO: 2514 - RNA, 21 nt, Homo Sapiens
ucaccucggcuccccggggcc

SEQ ID NO: 2515 - RNA, 21 nt, Homo Sapiens
ucgcgcacggcccgcgccgcc

SEQ ID NO: 2516 - RNA, 65 nt, Homo Sapiens
cgcuuucgcuccgcguucgcgcuuucgaccagaggggggggggcgcaccucgcuuaccgaaagug

SEQ ID NO: 2517 - RNA, 24 nt, Homo Sapiens
ucgcuccgcguucgcgcuuucgac

SEQ ID NO: 2518 - RNA, 22 nt, Homo Sapiens
cgcuccgcgggaggcgccuucg

SEQ ID NO: 2519 - RNA, 17 nt, Homo Sapiens
cgcucgcccgcgcuuuc

SEQ ID NO: 2520 - RNA, 19 nt, Homo Sapiens
gcucucgcaaucgcgcuuu

SEQ ID NO: 2521 - RNA, 24 nt, Homo Sapiens
gcuccagucgggccggcuuucgac

SEQ ID NO: 2522 - RNA, 19 nt, Homo Sapiens
ucgcuccgcucuucccgcu

SEQ ID NO: 2523 - RNA, 21 nt, Homo Sapiens
ucgcuccgcuucgccaucucg

SEQ ID NO: 2524 - RNA, 86 nt, Homo Sapiens
cgggggaguuguggugcuucugggucucugggccccgccugcuggccugggaugcccucauguugggaagcauuccgugccccccg

SEQ ID NO: 2525 - RNA, 24 nt, Homo Sapiens
gggaugcccucauguugggaagca

SEQ ID NO: 2526 - RNA, 22 nt, Homo Sapiens
augcccucauuucuuuggaaag

SEQ ID NO: 2527 - RNA, 19 nt, Homo Sapiens
cccuccauguugggcaagc

SEQ ID NO: 2528 - RNA, 19 nt, Homo Sapiens
gaugccuuucuugggaagc

SEQ ID NO: 2529 - RNA, 22 nt, Homo Sapiens
gggaugcccuccuguucaggaa

SEQ ID NO: 2530 - RNA, 22 nt, Homo Sapiens
ggcauugccucacuugggaagc

SEQ ID NO: 2531 - RNA, 21 nt, Homo Sapiens
gggaagccaggcugggaagca

SEQ ID NO: 2532 - RNA, 80 nt, Homo Sapiens
cgugagccaauucucccuaauaaacucccuuauauauguagucauauauccuacuaguucuguuccucuggagaaucaug

SEQ ID NO: 2533 - RNA, 24 nt, Homo Sapiens
uauccuacuaguucuguuccucug

SEQ ID NO: 2534 - RNA, 18 nt, Homo Sapiens
auccucacuucuguuccu

SEQ ID NO: 2535 - RNA, 20 nt, Homo Sapiens
auccuguuggcucuguuccu

SEQ ID NO: 2536 - RNA, 19 nt, Homo Sapiens
ccugcucaguucuguuccu

SEQ ID NO: 2537 - RNA, 21 nt, Homo Sapiens
uaucuuaaaguucuguuuccu

SEQ ID NO: 2538 - RNA, 21 nt, Homo Sapiens
uccuaccacuacguucuguuc

SEQ ID NO: 2539 - RNA, 19 nt, Homo Sapiens
uccugccagucuguuccuc

SEQ ID NO: 2540 - RNA, 64 nt, Homo Sapiens
cuacccucaccccaucacagcacccugagaaucacggguccaacugugugggagggggcugugg

SEQ ID NO: 2541 - RNA, 24 nt, Homo Sapiens
uacccucaccccaucacagcaccc

SEQ ID NO: 2542 - RNA, 21 nt, Homo Sapiens
acccugacgcucccaucacag

SEQ ID NO: 2543 - RNA, 21 nt, Homo Sapiens
acacccaccccaucaacagca

SEQ ID NO: 2544 - RNA, 19 nt, Homo Sapiens
acccucacccagccccagc

SEQ ID NO: 2545 - RNA, 17 nt, Homo Sapiens
acccucacccccacagc

SEQ ID NO: 2546 - RNA, 19 nt, Homo Sapiens
acccucaccaaucagagca

SEQ ID NO: 2547 - RNA, 19 nt, Homo Sapiens
acccucacccccacgucac

SEQ ID NO: 2548 - RNA, 22 nt, Homo Sapiens
acucucaccccaccccaccccc

SEQ ID NO: 2549 - RNA, 21 nt, Homo Sapiens
acccuuccccaucacagaccc

SEQ ID NO: 2550 - RNA, 22 nt, Homo Sapiens
cacccacauguccacagcaccc

SEQ ID NO: 2551 - RNA, 20 nt, Homo Sapiens
cccugcccaccccaucacag

SEQ ID NO: 2552 - RNA, 24 nt, Homo Sapiens
cccucaccccaccaucacggcccc

SEQ ID NO: 2553 - RNA, 20 nt, Homo Sapiens
cccccacccacaucacagca

SEQ ID NO: 2554 - RNA, 20 nt, Homo Sapiens
cccucacccucaacaaggac

SEQ ID NO: 2555 - RNA, 19 nt, Homo Sapiens
cccucaccccacguucaca

SEQ ID NO: 2556 - RNA, 19 nt, Homo Sapiens
cccucacccacccacacac

SEQ ID NO: 2557 - RNA, 21 nt, Homo Sapiens
cccucacccagacacagcccc

SEQ ID NO: 2558 - RNA, 20 nt, Homo Sapiens
cccucaccccucccagaacc

SEQ ID NO: 2559 - RNA, 20 nt, Homo Sapiens
cccucaccccagacaccucc

SEQ ID NO: 2560 - RNA, 20 nt, Homo Sapiens
ccucaccccaugcccucacc

SEQ ID NO: 2561 - RNA, 21 nt, Homo Sapiens
ccucuccccaccacagcaccc

SEQ ID NO: 2562 - RNA, 26 nt, Homo Sapiens
uacccucaccccuaccccauggcacc

SEQ ID NO: 2563 - RNA, 23 nt, Homo Sapiens
uacucucaccccagcccugaacc

SEQ ID NO: 2564 - RNA, 77 nt, Homo Sapiens
cuauaaacacggaagccaaauuugggaaagguguguuauuaagaauauguugcgacaagcgugguccgugcuuugag

SEQ ID NO: 2565 - RNA, 24 nt, Homo Sapiens
uguugcgacaagcgugguccgugc

SEQ ID NO: 2566 - RNA, 23 nt, Homo Sapiens
aauucugggaaagggauuguuau

SEQ ID NO: 2567 - RNA, 23 nt, Homo Sapiens
aauuugcuuuggaaagguguuuu

SEQ ID NO: 2568 - RNA, 28 nt, Homo Sapiens
aaucugggaaagggccauguguuuauua

SEQ ID NO: 2569 - RNA, 18 nt, Homo Sapiens
aauuugggaauguuuguu

SEQ ID NO: 2570 - RNA, 22 nt, Homo Sapiens
aauauggaauucuguguuauua

SEQ ID NO: 2571 - RNA, 24 nt, Homo Sapiens
auuugggaaaauuggaggguuuuu

SEQ ID NO: 2572 - RNA, 25 nt, Homo Sapiens
auuuuugaaauugguuuguuauuaa

SEQ ID NO: 2573 - RNA, 19 nt, Homo Sapiens
auuugggaaagucugcuau

SEQ ID NO: 2574 - RNA, 20 nt, Homo Sapiens
gacagaggcgaugguccgug

SEQ ID NO: 2575 - RNA, 19 nt, Homo Sapiens
gggacagguguguuuauua

SEQ ID NO: 2576 - RNA, 19 nt, Homo Sapiens
ugcaccaagcguggccuug

SEQ ID NO: 2577 - RNA, 18 nt, Homo Sapiens
ugcuaaagaugguccgug

SEQ ID NO: 2578 - RNA, 18 nt, Homo Sapiens
ugggacagcguggucgug

SEQ ID NO: 2579 - RNA, 22 nt, Homo Sapiens
ugagauaagauaguguuauuaa

SEQ ID NO: 2580 - RNA, 20 nt, Homo Sapiens
uuuggggccacagguguguu

SEQ ID NO: 2581 - RNA, 21 nt, Homo Sapiens
uuugggaaacggugugugauu

SEQ ID NO: 2582 - RNA, 19 nt, Homo Sapiens
uuugggaaagcugcuuguu

SEQ ID NO: 2583 - RNA, 67 nt, Homo Sapiens
cuaucaucaucuagcaccuguccgguuccccacgugagccuugggcaggacgcugcaguguugaugg

SEQ ID NO: 2584 - RNA, 24 nt, Homo Sapiens
uaucaucaucuagcaccuguccgg

SEQ ID NO: 2585 - RNA, 21 nt, Homo Sapiens
aucaucaucuuuagcauccug

SEQ ID NO: 2586 - RNA, 19 nt, Homo Sapiens
aucaucauccagcuugucc

SEQ ID NO: 2587 - RNA, 19 nt, Homo Sapiens
auccuuaccgccuguccgg

SEQ ID NO: 2588 - RNA, 19 nt, Homo Sapiens
caacaucugggcaccuguc

SEQ ID NO: 2589 - RNA, 17 nt, Homo Sapiens
caucuucccaccugucc

SEQ ID NO: 2590 - RNA, 24 nt, Homo Sapiens
uaucauaaccucuuggcaccuguc

SEQ ID NO: 2591 - RNA, 19 nt, Homo Sapiens
uauaagcagcagcaccugu

SEQ ID NO: 2592 - RNA, 20 nt, Homo Sapiens
uauugucauccagcaccugu

SEQ ID NO: 2593 - RNA, 20 nt, Homo Sapiens
uccuccagccgccuguccgg

SEQ ID NO: 2594 - RNA, 19 nt, Homo Sapiens
ucuuccagucccuguccgg

SEQ ID NO: 2595 - RNA, 61 nt, Homo Sapiens
cuauuuuuuauuugcaacuacaugauuucacacaauucucuuaaacaacgacauaaaauag

SEQ ID NO: 2596 - RNA, 22 nt, Homo Sapiens
cuuaaacaacgacauaaaauag

SEQ ID NO: 2597 - RNA, 24 nt, Homo Sapiens
auuguuuuauuugguuuaaacuac

SEQ ID NO: 2598 - RNA, 21 nt, Homo Sapiens
uuuuuauuuuguaaaccacau

SEQ ID NO: 2599 - RNA, 18 nt, Homo Sapiens
uuuuauauuugcaacaca

SEQ ID NO: 2600 - RNA, 69 nt, Homo Sapiens
cuccagagcuccuauagggcaagacacuguuucucauauauuucuggauccuuggagcuuagcucggag

SEQ ID NO: 2601 - RNA, 24 nt, Homo Sapiens
auuucuggauccuuggagcuuagc

SEQ ID NO: 2602 - RNA, 23 nt, Homo Sapiens
auuucuggagaccgaggaguuua

SEQ ID NO: 2603 - RNA, 19 nt, Homo Sapiens
auuucuggaccuucugagc

SEQ ID NO: 2604 - RNA, 19 nt, Homo Sapiens
aucucuggaucccugugag

SEQ ID NO: 2605 - RNA, 19 nt, Homo Sapiens
auuuggggcuuggagcuua

SEQ ID NO: 2606 - RNA, 22 nt, Homo Sapiens
auuugucaauccuuggagccua

SEQ ID NO: 2607 - RNA, 22 nt, Homo Sapiens
aucucaggaccuggagcuuagc

SEQ ID NO: 2608 - RNA, 20 nt, Homo Sapiens
cugaguccuuggagcucagc

SEQ ID NO: 2609 - RNA, 21 nt, Homo Sapiens
ucuggauuauugcaggucuua

SEQ ID NO: 2610 - RNA, 20 nt, Homo Sapiens
uucugauuccccuuggagcu

SEQ ID NO: 2611 - RNA, 21 nt, Homo Sapiens
uucagggacccuggagcuuag

SEQ ID NO: 2612 - RNA, 17 nt, Homo Sapiens
uucugcuuggagcugag

SEQ ID NO: 2613 - RNA, 20 nt, Homo Sapiens
uucgggcuccugagcuuagc

SEQ ID NO: 2614 - RNA, 20 nt, Homo Sapiens
uuuccuuggauuuggagcuu

SEQ ID NO: 2615 - RNA, 20 nt, Homo Sapiens
uuucuggaugccucucagcu

SEQ ID NO: 2616 - RNA, 18 nt, Homo Sapiens
uugcuggauccuggagcu

SEQ ID NO: 2617 - RNA, 20 nt, Homo Sapiens
uuucugauccuuggaauuag

SEQ ID NO: 2618 - RNA, 21 nt, Homo Sapiens
uuuugggauccuuggacugag

SEQ ID NO: 2619 - RNA, 66 nt, Homo Sapiens
cucccacccugccggccucaggaacagcuggcuccagaugggggguggcaggcagugaagugggag

SEQ ID NO: 2620 - RNA, 24 nt, Homo Sapiens
ugggggguggcaggcagugaagug

SEQ ID NO: 2621 - RNA, 22 nt, Homo Sapiens
gggggacugaggcaggcaggga

SEQ ID NO: 2622 - RNA, 19 nt, Homo Sapiens
gggggguggcugcugcagu

SEQ ID NO: 2623 - RNA, 19 nt, Homo Sapiens
gggagguggcaggcaggga

SEQ ID NO: 2624 - RNA, 20 nt, Homo Sapiens
ggagggaggcaggcagggaa

SEQ ID NO: 2625 - RNA, 21 nt, Homo Sapiens
gguggcgggcaggcaguggag

SEQ ID NO: 2626 - RNA, 19 nt, Homo Sapiens
gggggugggcaggcagaga

SEQ ID NO: 2627 - RNA, 21 nt, Homo Sapiens
ggggguggcaguggaguggag

SEQ ID NO: 2628 - RNA, 22 nt, Homo Sapiens
ggagguggcaggaccagaagug

SEQ ID NO: 2629 - RNA, 18 nt, Homo Sapiens
ggggguggcacagaagug

SEQ ID NO: 2630 - RNA, 21 nt, Homo Sapiens
ggggguggcggguacugagug

SEQ ID NO: 2631 - RNA, 19 nt, Homo Sapiens
gggguggcagggggcagug

SEQ ID NO: 2632 - RNA, 22 nt, Homo Sapiens
gggguggcaguggcggugaugu

SEQ ID NO: 2633 - RNA, 19 nt, Homo Sapiens
ggaguggcaaggcagugaa

SEQ ID NO: 2634 - RNA, 21 nt, Homo Sapiens
ggguggcagagguugcaguga

SEQ ID NO: 2635 - RNA, 25 nt, Homo Sapiens
uggcgggguacaggcaggcaggaag

SEQ ID NO: 2636 - RNA, 24 nt, Homo Sapiens
uggaggggugggcaggcagggaag

SEQ ID NO: 2637 - RNA, 24 nt, Homo Sapiens
uggggaaguggcaggcaggugcag

SEQ ID NO: 2638 - RNA, 20 nt, Homo Sapiens
uggggugugcccaggcagug

SEQ ID NO: 2639 - RNA, 25 nt, Homo Sapiens
ugugggguggcagagcccagaagug

SEQ ID NO: 2640 - RNA, 21 nt, Homo Sapiens
ugggcgguggcagguagguga

SEQ ID NO: 2641 - RNA, 20 nt, Homo Sapiens
uggggggugguauggagaga

SEQ ID NO: 2642 - RNA, 17 nt, Homo Sapiens
uggggggugggggugaa

SEQ ID NO: 2643 - RNA, 88 nt, Homo Sapiens
cucucucuuccagcugcagaugccacacuguccucugcuucccggggacgagggggugggcgggacuggguacagguugggaggggag

SEQ ID NO: 2644 - RNA, 24 nt, Homo Sapiens
ugccacacuguccucugcuucccg

SEQ ID NO: 2645 - RNA, 17 nt, Homo Sapiens
cacauccucugcuuccc

SEQ ID NO: 2646 - RNA, 19 nt, Homo Sapiens
cacacaggcucugcuuccc

SEQ ID NO: 2647 - RNA, 19 nt, Homo Sapiens
cacacggccacugcuuccc

SEQ ID NO: 2648 - RNA, 21 nt, Homo Sapiens
cacugcaaccucugcuucccg

SEQ ID NO: 2649 - RNA, 19 nt, Homo Sapiens
cacuguccuaccugcugcc

SEQ ID NO: 2650 - RNA, 18 nt, Homo Sapiens
cacugucccugcuucccg

SEQ ID NO: 2651 - RNA, 21 nt, Homo Sapiens
ccacagcuuucacucugcuuc

SEQ ID NO: 2652 - RNA, 20 nt, Homo Sapiens
ccucaguguccucuguuccc

SEQ ID NO: 2653 - RNA, 21 nt, Homo Sapiens
ccucucuggcuucugcuuccc

SEQ ID NO: 2654 - RNA, 20 nt, Homo Sapiens
ccacgccgcucugcuucacg

SEQ ID NO: 2655 - RNA, 24 nt, Homo Sapiens
gccaacacuguccucuaaguuucc

SEQ ID NO: 2656 - RNA, 25 nt, Homo Sapiens
gccacacuguccucagaguguuccc

SEQ ID NO: 2657 - RNA, 26 nt, Homo Sapiens
ugccucaucuuuccucacugcuuccc

SEQ ID NO: 2658 - RNA, 21 nt, Homo Sapiens
ugccaaacuggguccucugcu

SEQ ID NO: 2659 - RNA, 26 nt, Homo Sapiens
uggcucacugcagacucugcuucccg

SEQ ID NO: 2660 - RNA, 23 nt, Homo Sapiens
ugccacacugcccugcauuuccc

SEQ ID NO: 2661 - RNA, 20 nt, Homo Sapiens
ugcaacaccuaccucugcuu

SEQ ID NO: 2662 - RNA, 19 nt, Homo Sapiens
uggcacccagccucugcuu

SEQ ID NO: 2663 - RNA, 21 nt, Homo Sapiens
ugccacacucaccuagcuucc

SEQ ID NO: 2664 - RNA, 23 nt, Homo Sapiens
ugccacacucuccccuacagccc

SEQ ID NO: 2665 - RNA, 21 nt, Homo Sapiens
ugccccgcuuccugcuucccg

SEQ ID NO: 2666 - RNA, 73 nt, Homo Sapiens
cucugacaacaguggcuggacugaaauccgccgggaagccugggucuccucuagcuuauuggugucuccagag

SEQ ID NO: 2667 - RNA, 24 nt, Homo Sapiens
acaacaguggcuggacugaaaucc

SEQ ID NO: 2668 - RNA, 19 nt, Homo Sapiens
aacaguggcaggauuugaa

SEQ ID NO: 2669 - RNA, 19 nt, Homo Sapiens
aacaguggcugcacagaaa

SEQ ID NO: 2670 - RNA, 19 nt, Homo Sapiens
aacagcucggcugaaaucc

SEQ ID NO: 2671 - RNA, 19 nt, Homo Sapiens
acagcaguggcuggcuuga

SEQ ID NO: 2672 - RNA, 20 nt, Homo Sapiens
acaacagugcauggcuaaaa

SEQ ID NO: 2673 - RNA, 23 nt, Homo Sapiens
acaguggcuuacaccuguaaucc

SEQ ID NO: 2674 - RNA, 23 nt, Homo Sapiens
acaguggcucacaacuguaaucc

SEQ ID NO: 2675 - RNA, 23 nt, Homo Sapiens
acaguggcucacgccuguaaucc

SEQ ID NO: 2676 - RNA, 23 nt, Homo Sapiens
acaguggcucaugccuguaaucc

SEQ ID NO: 2677 - RNA, 22 nt, Homo Sapiens
acaguggcucacaccuguaauc

SEQ ID NO: 2678 - RNA, 23 nt, Homo Sapiens
acaguggcucacaccuguaaucc

SEQ ID NO: 2679 - RNA, 21 nt, Homo Sapiens
cauccgugcaggcugaaaucc

SEQ ID NO: 2680 - RNA, 19 nt, Homo Sapiens
caguggcuggauuccaauc

SEQ ID NO: 2681 - RNA, 19 nt, Homo Sapiens
ggcuggacuccgaaacucc

SEQ ID NO: 2682 - RNA, 95 nt, Homo Sapiens
cucugcacagcagcccagcagggauguccucucuagagaugguuuaucaaggguaccccaugagagggcagcuccugaugcagcugccggaagag

SEQ ID NO: 2683 - RNA, 24 nt, Homo Sapiens
ugagagggcagcuccugaugcagc

SEQ ID NO: 2684 - RNA, 18 nt, Homo Sapiens
agcgggcagcuccgacgc

SEQ ID NO: 2685 - RNA, 19 nt, Homo Sapiens
agggccaagcuccugaggc

SEQ ID NO: 2686 - RNA, 21 nt, Homo Sapiens
gagacgccagcuccugcucca

SEQ ID NO: 2687 - RNA, 21 nt, Homo Sapiens
gagagggcaggcccgaggcag

SEQ ID NO: 2688 - RNA, 21 nt, Homo Sapiens
gagggcagcucgcucugcagc

SEQ ID NO: 2689 - RNA, 21 nt, Homo Sapiens
gauggccucuucugaugcagc

SEQ ID NO: 2690 - RNA, 25 nt, Homo Sapiens
ugggaggguauucagcuccugaagc

SEQ ID NO: 2691 - RNA, 20 nt, Homo Sapiens
ugagccggcgcuccugaugc

SEQ ID NO: 2692 - RNA, 64 nt, Homo Sapiens
cugacacaugaggcaaaaggcuccgacgaugcuccagacgcggacacggccaucaucaaugcag

SEQ ID NO: 2693 - RNA, 24 nt, Homo Sapiens
ugacacaugaggcaaaaggcuccg

SEQ ID NO: 2694 - RNA, 19 nt, Homo Sapiens
acagaugaguggcaaaagg

SEQ ID NO: 2695 - RNA, 19 nt, Homo Sapiens
acacauaggcaaaaggucc

SEQ ID NO: 2696 - RNA, 21 nt, Homo Sapiens
acaggaggaacaaaaggcucc

SEQ ID NO: 2697 - RNA, 21 nt, Homo Sapiens
acauuacacaagaaggcuccg

SEQ ID NO: 2698 - RNA, 21 nt, Homo Sapiens
cacacuaaggcaaaagggcuc

SEQ ID NO: 2699 - RNA, 19 nt, Homo Sapiens
cacaaugaggcaaaggccu

SEQ ID NO: 2700 - RNA, 21 nt, Homo Sapiens
cacaggccaggaaaggcuccg

SEQ ID NO: 2701 - RNA, 19 nt, Homo Sapiens
cacaggcaggcaaaagcuc

SEQ ID NO: 2702 - RNA, 19 nt, Homo Sapiens
gacacaugaggccaagagg

SEQ ID NO: 2703 - RNA, 19 nt, Homo Sapiens
ugaaacaaucaggcaaaag

SEQ ID NO: 2704 - RNA, 19 nt, Homo Sapiens
uggcacugagggcaaaagg

SEQ ID NO: 2705 - RNA, 26 nt, Homo Sapiens
ugucacagagggcagagaaaggcucc

SEQ ID NO: 2706 - RNA, 60 nt, Homo Sapiens
cugacuuguuggacgggaaucugguuauuuggcaccgcccuucuguucauaacagguugg

SEQ ID NO: 2707 - RNA, 24 nt, Homo Sapiens
ugacuuguuggacgggaaucuggu

SEQ ID NO: 2708 - RNA, 21 nt, Homo Sapiens
cuuggugacugggaaucuggu

SEQ ID NO: 2709 - RNA, 19 nt, Homo Sapiens
cuugugcuugggaaucugg

SEQ ID NO: 2710 - RNA, 20 nt, Homo Sapiens
gaguuguuggacaagcuggu

SEQ ID NO: 2711 - RNA, 26 nt, Homo Sapiens
ugacuuuuaugcucagugaaucuggu

SEQ ID NO: 2712 - RNA, 21 nt, Homo Sapiens
ugacuuguugagaaugguauc

SEQ ID NO: 2713 - RNA, 23 nt, Homo Sapiens
ugacuuuggaccuggaaucuggu

SEQ ID NO: 2714 - RNA, 20 nt, Homo Sapiens
uuggacgggaagcagucugg

SEQ ID NO: 2715 - RNA, 62 nt, Homo Sapiens
cugagaauuucucuugcaugccuuagcuuuacagcuuuugcauuccuguggauuauucucag

SEQ ID NO: 2716 - RNA, 24 nt, Homo Sapiens
ugagaauuucucuugcaugccuua

SEQ ID NO: 2717 - RNA, 19 nt, Homo Sapiens
aauucccucuugcauuccu

SEQ ID NO: 2718 - RNA, 20 nt, Homo Sapiens
aaugucucgcuugcaugccu

SEQ ID NO: 2719 - RNA, 23 nt, Homo Sapiens
agaaagcucucacuugcaugccu

SEQ ID NO: 2720 - RNA, 22 nt, Homo Sapiens
agaauguuucucuugccuuccu

SEQ ID NO: 2721 - RNA, 21 nt, Homo Sapiens
agaauuucuaccuuccgccuu

SEQ ID NO: 2722 - RNA, 21 nt, Homo Sapiens
agaauuucucuguacuggcuu

SEQ ID NO: 2723 - RNA, 18 nt, Homo Sapiens
agaauuucuacuccagcc

SEQ ID NO: 2724 - RNA, 22 nt, Homo Sapiens
agcauuucucuucuauaacuua

SEQ ID NO: 2725 - RNA, 20 nt, Homo Sapiens
gagaauuucugcuggcccuu

SEQ ID NO: 2726 - RNA, 21 nt, Homo Sapiens
gagaauuucuuuucagucccu

SEQ ID NO: 2727 - RNA, 22 nt, Homo Sapiens
ugacgaauugcuucucuugcau

SEQ ID NO: 2728 - RNA, 23 nt, Homo Sapiens
ugaaauauuucucuuucaauccu

SEQ ID NO: 2729 - RNA, 22 nt, Homo Sapiens
ugagaaauuucucuccugcuua

SEQ ID NO: 2730 - RNA, 22 nt, Homo Sapiens
ugagaauuuuagucuccaugcc

SEQ ID NO: 2731 - RNA, 26 nt, Homo Sapiens
ugagaauuucaagucuggaaaugccu

SEQ ID NO: 2732 - RNA, 23 nt, Homo Sapiens
ugagaauuucauccuuccacuua

SEQ ID NO: 2733 - RNA, 25 nt, Homo Sapiens
ugagcaugcugcuuggcaugccuua

SEQ ID NO: 2734 - RNA, 63 nt, Homo Sapiens
cugcacauaucaucgcggaauucauucggcuuccagcaagcugacacuccaugauacaagcgg

SEQ ID NO: 2735 - RNA, 24 nt, Homo Sapiens
uaucaucgcggaauucauucggcu

SEQ ID NO: 2736 - RNA, 17 nt, Homo Sapiens
caucgaauucauucugc

SEQ ID NO: 2737 - RNA, 72 nt, Homo Sapiens
cugcaucaaagguagacuuucgcacagguugugagguuggagucacaguguuauuuguuguaccugauguag

SEQ ID NO: 2738 - RNA, 24 nt, Homo Sapiens
ucaaagguagacuuucgcacaggu

SEQ ID NO: 2739 - RNA, 19 nt, Homo Sapiens
aaaggcuauauucgcacag

SEQ ID NO: 2740 - RNA, 20 nt, Homo Sapiens
aaauguagacuuugcaacag

SEQ ID NO: 2741 - RNA, 26 nt, Homo Sapiens
caaagguagacucaagucucgcagag

SEQ ID NO: 2742 - RNA, 21 nt, Homo Sapiens
ucaaagguauacauuuggaac

SEQ ID NO: 2743 - RNA, 23 nt, Homo Sapiens
ucaaagguaggauuuccuccagg

SEQ ID NO: 2744 - RNA, 64 nt, Homo Sapiens
cugccaaugucgauuggccuuaauuuggcaaaaaaaaaaauggggggccgaaauaaaugggcgg

SEQ ID NO: 2745 - RNA, 24 nt, Homo Sapiens
uggggggccgaaauaaaugggcgg

SEQ ID NO: 2746 - RNA, 19 nt, Homo Sapiens
caaugucuccauuggccuu

SEQ ID NO: 2747 - RNA, 22 nt, Homo Sapiens
caaaaucaacugugccuuaauu

SEQ ID NO: 2748 - RNA, 20 nt, Homo Sapiens
gccagaguagaggccuuaau

SEQ ID NO: 2749 - RNA, 19 nt, Homo Sapiens
ugccacucccuuggccuua

SEQ ID NO: 2750 - RNA, 20 nt, Homo Sapiens
ugccaauguaaugccuuuau

SEQ ID NO: 2751 - RNA, 24 nt, Homo Sapiens
ugcagauguccaauagccuuaauu

SEQ ID NO: 2752 - RNA, 20 nt, Homo Sapiens
ugucgcuccguggccuuaau

SEQ ID NO: 2753 - RNA, 62 nt, Homo Sapiens
cugccaguaugcuguuagucaagaguccucaguaggagaacuugagugaaacguacacccag

SEQ ID NO: 2754 - RNA, 24 nt, Homo Sapiens
ugccaguaugcuguuagucaagag

SEQ ID NO: 2755 - RNA, 20 nt, Homo Sapiens
augcuguuaguuauacaaga

SEQ ID NO: 2756 - RNA, 22 nt, Homo Sapiens
caguauaggucuaagucaagag

SEQ ID NO: 2757 - RNA, 18 nt, Homo Sapiens
ccagagcuguuagucuag

SEQ ID NO: 2758 - RNA, 19 nt, Homo Sapiens
gcaauuaugcuguuaggca

SEQ ID NO: 2759 - RNA, 20 nt, Homo Sapiens
guaugcuguauaguaaaaag

SEQ ID NO: 2760 - RNA, 19 nt, Homo Sapiens
guaugcugucaggcgacag

SEQ ID NO: 2761 - RNA, 22 nt, Homo Sapiens
ugccaguaucgcagcgauucaa

SEQ ID NO: 2762 - RNA, 26 nt, Homo Sapiens
ugucaauaugcuguugauucccagag

SEQ ID NO: 2763 - RNA, 63 nt, Homo Sapiens
cugcgagccauucacccagcuggucccuccaagacagagccggggccagcggcagacucccag

SEQ ID NO: 2764 - RNA, 24 nt, Homo Sapiens
ugcgagccauucacccagcugguc

SEQ ID NO: 2765 - RNA, 20 nt, Homo Sapiens
agcucuuucacccaggcugg

SEQ ID NO: 2766 - RNA, 21 nt, Homo Sapiens
agcccuuauucacccaugcug

SEQ ID NO: 2767 - RNA, 22 nt, Homo Sapiens
gagucgauucagacccagcugg

SEQ ID NO: 2768 - RNA, 19 nt, Homo Sapiens
gagccauauaacccagcug

SEQ ID NO: 2769 - RNA, 20 nt, Homo Sapiens
gagccagcucccccagcugg

SEQ ID NO: 2770 - RNA, 22 nt, Homo Sapiens
gaggcccucacuccagcugguc

SEQ ID NO: 2771 - RNA, 16 nt, Homo Sapiens
gauccaacccagcugg

SEQ ID NO: 2772 - RNA, 17 nt, Homo Sapiens
gagcucccccagcuggu

SEQ ID NO: 2773 - RNA, 20 nt, Homo Sapiens
gaggcuucccacagcugguc

SEQ ID NO: 2774 - RNA, 18 nt, Homo Sapiens
gcgacuccauucaccagc

SEQ ID NO: 2775 - RNA, 17 nt, Homo Sapiens
gcgagccauccccggcu

SEQ ID NO: 2776 - RNA, 21 nt, Homo Sapiens
gcgaggcagggucccagcugg

SEQ ID NO: 2777 - RNA, 23 nt, Homo Sapiens
gcuagagauccacacagcugguc

SEQ ID NO: 2778 - RNA, 23 nt, Homo Sapiens
ugcugagacaacuaccagcuggu

SEQ ID NO: 2779 - RNA, 24 nt, Homo Sapiens
ugcggggccaguaaccccagcugg

SEQ ID NO: 2780 - RNA, 19 nt, Homo Sapiens
ugcgagccaagcccccugc

SEQ ID NO: 2781 - RNA, 19 nt, Homo Sapiens
ugcgagccagucugacagc

SEQ ID NO: 2782 - RNA, 19 nt, Homo Sapiens
ugccagauucacccaguug

SEQ ID NO: 2783 - RNA, 60 nt, Homo Sapiens
cugcugcgcccuguccuccgucggcucugcgggcucccgggccuacagcggcugcggcag

SEQ ID NO: 2784 - RNA, 24 nt, Homo Sapiens
ucccgggccuacagcggcugcggc

SEQ ID NO: 2785 - RNA, 19 nt, Homo Sapiens
ccaggggcucacagcggcu

SEQ ID NO: 2786 - RNA, 23 nt, Homo Sapiens
cccggcuccagcaaggcugcggc

SEQ ID NO: 2787 - RNA, 19 nt, Homo Sapiens
cccgggccuccaccucugc

SEQ ID NO: 2788 - RNA, 23 nt, Homo Sapiens
ccccugcccacagcggcugcggc

SEQ ID NO: 2789 - RNA, 18 nt, Homo Sapiens
cccgggccuaggcugggc

SEQ ID NO: 2790 - RNA, 20 nt, Homo Sapiens
ucccgggccaggacagaggc

SEQ ID NO: 2791 - RNA, 25 nt, Homo Sapiens
ucccgcccccuacagcgagcugggg

SEQ ID NO: 2792 - RNA, 21 nt, Homo Sapiens
ucccgggcccccaucugcagc

SEQ ID NO: 2793 - RNA, 19 nt, Homo Sapiens
ucccgggccuagcgccugc

SEQ ID NO: 2794 - RNA, 69 nt, Homo Sapiens
cugggaauauaauggccuauucaccaggcaccaguuaagggugccacuaauuggccgugaacuucccag

SEQ ID NO: 2795 - RNA, 24 nt, Homo Sapiens
uauaauggccuauucaccaggcac

SEQ ID NO: 2796 - RNA, 18 nt, Homo Sapiens
aaaggcccacaccaggca

SEQ ID NO: 2797 - RNA, 18 nt, Homo Sapiens
aucauggagucaccaggc

SEQ ID NO: 2798 - RNA, 22 nt, Homo Sapiens
ggccucuucucugaccaggcac

SEQ ID NO: 2799 - RNA, 17 nt, Homo Sapiens
uaauggccuguuacagg

SEQ ID NO: 2800 - RNA, 16 nt, Homo Sapiens
uauaacuuauucacca

SEQ ID NO: 2801 - RNA, 20 nt, Homo Sapiens
uauaauggccucagcaacag

SEQ ID NO: 2802 - RNA, 25 nt, Homo Sapiens
uaaaauggccuacuuaucugugcac

SEQ ID NO: 2803 - RNA, 24 nt, Homo Sapiens
uggccuauuccuugaccaaagcac

SEQ ID NO: 2804 - RNA, 20 nt, Homo Sapiens
uggacaguuccaccaggcac

SEQ ID NO: 2805 - RNA, 15 nt, Homo Sapiens
uggcccaccaggcac

SEQ ID NO: 2806 - RNA, 19 nt, Homo Sapiens
uggccuucugaccaggcac

SEQ ID NO: 2807 - RNA, 69 nt, Homo Sapiens
cugggauggggaccgcggaaguucccaccgaugcggccggcggggcccagccuugguccccagcuccgg

SEQ ID NO: 2808 - RNA, 24 nt, Homo Sapiens
ugggauggggaccgcggaaguucc

SEQ ID NO: 2809 - RNA, 21 nt, Homo Sapiens
gauggggacuccucguggaag

SEQ ID NO: 2810 - RNA, 22 nt, Homo Sapiens
ggacucgggagcgccgcggaag

SEQ ID NO: 2811 - RNA, 21 nt, Homo Sapiens
ggcugguguccgcgcggaagu

SEQ ID NO: 2812 - RNA, 20 nt, Homo Sapiens
ggaaggagagaggaaguucc

SEQ ID NO: 2813 - RNA, 23 nt, Homo Sapiens
gggaugggggaccccacaguucc

SEQ ID NO: 2814 - RNA, 21 nt, Homo Sapiens
gggauggggagcaggggcgga

SEQ ID NO: 2815 - RNA, 24 nt, Homo Sapiens
gggaugggggucgccugggacuuc

SEQ ID NO: 2816 - RNA, 24 nt, Homo Sapiens
gggcuugggacugugggaaguucc

SEQ ID NO: 2817 - RNA, 16 nt, Homo Sapiens
gggaggaccgcggcag

SEQ ID NO: 2818 - RNA, 19 nt, Homo Sapiens
gggaugggggacggagaag

SEQ ID NO: 2819 - RNA, 19 nt, Homo Sapiens
gggaugggggcguuggaag

SEQ ID NO: 2820 - RNA, 20 nt, Homo Sapiens
gggauggggccgguggaggu

SEQ ID NO: 2821 - RNA, 22 nt, Homo Sapiens
ugggaugggcaggucagcggaa

SEQ ID NO: 2822 - RNA, 20 nt, Homo Sapiens
ugggcggggcuggaccgcgg

SEQ ID NO: 2823 - RNA, 18 nt, Homo Sapiens
ugggauggggagugggaa

SEQ ID NO: 2824 - RNA, 19 nt, Homo Sapiens
ugggauggggacggagaag

SEQ ID NO: 2825 - RNA, 17 nt, Homo Sapiens
ugggauggggagaaguu

SEQ ID NO: 2826 - RNA, 78 nt, Homo Sapiens
cugggcuuugggccuggugguugggagucaccuacugacaucgggacugacauuccugaaccccugguaugaggccag

SEQ ID NO: 2827 - RNA, 24 nt, Homo Sapiens
ugacauuccugaaccccugguaug

SEQ ID NO: 2828 - RNA, 21 nt, Homo Sapiens
acauuccugaagagcacuggu

SEQ ID NO: 2829 - RNA, 21 nt, Homo Sapiens
acauuccugagcacccaggua

SEQ ID NO: 2830 - RNA, 19 nt, Homo Sapiens
acauuccugaaucccaggu

SEQ ID NO: 2831 - RNA, 22 nt, Homo Sapiens
acacgccugaacccuggguuug

SEQ ID NO: 2832 - RNA, 18 nt, Homo Sapiens
cuggauggugggagucac

SEQ ID NO: 2833 - RNA, 19 nt, Homo Sapiens
cuggugguuaugaaucacc

SEQ ID NO: 2834 - RNA, 19 nt, Homo Sapiens
cuggugguuugggcugacc

SEQ ID NO: 2835 - RNA, 23 nt, Homo Sapiens
cuggggguugggagucacaucug

SEQ ID NO: 2836 - RNA, 20 nt, Homo Sapiens
ggugguugguagaggcagcu

SEQ ID NO: 2837 - RNA, 19 nt, Homo Sapiens
gguugggaggcagcagcug

SEQ ID NO: 2838 - RNA, 21 nt, Homo Sapiens
guaguaaguagucaccuauug

SEQ ID NO: 2839 - RNA, 21 nt, Homo Sapiens
uccuggggaaccccugguaug

SEQ ID NO: 2840 - RNA, 22 nt, Homo Sapiens
ugacucuugaaaucccugguau

SEQ ID NO: 2841 - RNA, 19 nt, Homo Sapiens
ugacagcugcaccccuggu

SEQ ID NO: 2842 - RNA, 22 nt, Homo Sapiens
ugggggugggggacaccuacug

SEQ ID NO: 2843 - RNA, 22 nt, Homo Sapiens
uggggguugggagucacaucug

SEQ ID NO: 2844 - RNA, 20 nt, Homo Sapiens
ugguacagaggcaccuacug

SEQ ID NO: 2845 - RNA, 22 nt, Homo Sapiens
uucuagaacuuccccugguaug

SEQ ID NO: 2846 - RNA, 79 nt, Homo Sapiens
cugggguguuuauggcaagucacuuugacagacauuauugugggcaaauguugucugacuuacuguuucaacaaaccag

SEQ ID NO: 2847 - RNA, 24 nt, Homo Sapiens
uggcaagucacuuugacagacauu

SEQ ID NO: 2848 - RNA, 24 nt, Homo Sapiens
aagucaaccgcugguugacagaca

SEQ ID NO: 2849 - RNA, 19 nt, Homo Sapiens
aagucacuuugaauuacau

SEQ ID NO: 2850 - RNA, 19 nt, Homo Sapiens
aauucacuuugacacucau

SEQ ID NO: 2851 - RNA, 20 nt, Homo Sapiens
aagucacuuuuguggacauu

SEQ ID NO: 2852 - RNA, 21 nt, Homo Sapiens
gcuauugacuuugacaggcau

SEQ ID NO: 2853 - RNA, 25 nt, Homo Sapiens
ggcaagucagccuuugcauaagaca

SEQ ID NO: 2854 - RNA, 20 nt, Homo Sapiens
ggcagacagucugacagaca

SEQ ID NO: 2855 - RNA, 21 nt, Homo Sapiens
ucacuucuacaugacagacau

SEQ ID NO: 2856 - RNA, 22 nt, Homo Sapiens
uggcaaaagucacuucagcauu

SEQ ID NO: 2857 - RNA, 21 nt, Homo Sapiens
uggcaccgucucuuugacaga

SEQ ID NO: 2858 - RNA, 83 nt, Homo Sapiens
cuggugcaucaguuguucccggcgcaggcccccguugaucguggcgcuggugcugcugacggagcugcugguucugcugccag

SEQ ID NO: 2859 - RNA, 24 nt, Homo Sapiens
ucaguuguucccggcgcaggcccc

SEQ ID NO: 2860 - RNA, 21 nt, Homo Sapiens
aguuguggcuccggcgcaggc

SEQ ID NO: 2861 - RNA, 22 nt, Homo Sapiens
aguuguuccugccaccgugccc

SEQ ID NO: 2862 - RNA, 19 nt, Homo Sapiens
agugaugcccggcgcaggc

SEQ ID NO: 2863 - RNA, 23 nt, Homo Sapiens
cagugugcagggacgcaggcccc

SEQ ID NO: 2864 - RNA, 22 nt, Homo Sapiens
caguuucacgggcgcaggcccc

SEQ ID NO: 2865 - RNA, 18 nt, Homo Sapiens
caggugcaggcgcaggcc

SEQ ID NO: 2866 - RNA, 21 nt, Homo Sapiens
cagucgugccgggcgcaggcc

SEQ ID NO: 2867 - RNA, 21 nt, Homo Sapiens
guucccggcagcccaggcacc

SEQ ID NO: 2868 - RNA, 22 nt, Homo Sapiens
guuguucccgcgcgucgccccc

SEQ ID NO: 2869 - RNA, 23 nt, Homo Sapiens
ucugucugucucuuggcgcaggc

SEQ ID NO: 2870 - RNA, 25 nt, Homo Sapiens
ucauuucugccccugugcaggcccc

SEQ ID NO: 2871 - RNA, 19 nt, Homo Sapiens
ucaguuguuuauggcacag

SEQ ID NO: 2872 - RNA, 18 nt, Homo Sapiens
ucagcugcgggcgcaggc

SEQ ID NO: 2873 - RNA, 22 nt, Homo Sapiens
ucaguggcugggagcaggcccc

SEQ ID NO: 2874 - RNA, 66 nt, Homo Sapiens
cugguuaacuucuugagcuauuucguggaacuuggaacacagccugccacccagugaaguguccag

SEQ ID NO: 2875 - RNA, 19 nt, Homo Sapiens
cacccagugaaguguccag

SEQ ID NO: 2876 - RNA, 22 nt, Homo Sapiens
cacccagugagcacagagucca

SEQ ID NO: 2877 - RNA, 16 nt, Homo Sapiens
cacccaguggugccag

SEQ ID NO: 2878 - RNA, 19 nt, Homo Sapiens
cacccagugaugcaucuag

SEQ ID NO: 2879 - RNA, 19 nt, Homo Sapiens
ccaaguagacaguguccag

SEQ ID NO: 2880 - RNA, 68 nt, Homo Sapiens
cuguccccaagcgcaugccaucugcagccagcagucuuggaacuuugguugguggcaccaggggacag

SEQ ID NO: 2881 - RNA, 23 nt, Homo Sapiens
ugguugguggcaccaggggacag

SEQ ID NO: 2882 - RNA, 23 nt, Homo Sapiens
gguggcaccacagccugggacag

SEQ ID NO: 2883 - RNA, 20 nt, Homo Sapiens
gguugguggcccuugggcac

SEQ ID NO: 2884 - RNA, 21 nt, Homo Sapiens
gguuggggcaagaggggacag

SEQ ID NO: 2885 - RNA, 20 nt, Homo Sapiens
guugguggcacauguagaca

SEQ ID NO: 2886 - RNA, 19 nt, Homo Sapiens
guuggugggacaggggaca

SEQ ID NO: 2887 - RNA, 23 nt, Homo Sapiens
uggcuuaguggcauaggggacag

SEQ ID NO: 2888 - RNA, 20 nt, Homo Sapiens
ugggugcagccaggggacag

SEQ ID NO: 2889 - RNA, 21 nt, Homo Sapiens
uguuggcagcauaggggacag

SEQ ID NO: 2890 - RNA, 24 nt, Homo Sapiens
uguuugggcaggcagcaggggaca

SEQ ID NO: 2891 - RNA, 23 nt, Homo Sapiens
ugguugguguacuccaggagcag

SEQ ID NO: 2892 - RNA, 24 nt, Homo Sapiens
ugguaggaggggagcaggggacag

SEQ ID NO: 2893 - RNA, 23 nt, Homo Sapiens
ugaugggugacgacaggggacag

SEQ ID NO: 2894 - RNA, 21 nt, Homo Sapiens
uugcugcaagccccaggggac

SEQ ID NO: 2895 - RNA, 19 nt, Homo Sapiens
uugguggcaccuggggcca

SEQ ID NO: 2896 - RNA, 20 nt, Homo Sapiens
uugguggcagcagccaacag

SEQ ID NO: 2897 - RNA, 20 nt, Homo Sapiens
uugguggcaucugugggcag

SEQ ID NO: 2898 - RNA, 65 nt, Homo Sapiens
cugucuguucauauguugguuaugacuuuuacauuaaaauaucauuuaaacgaaugagcaaucag

SEQ ID NO: 2899 - RNA, 23 nt, Homo Sapiens
cauuuaaacgaaugagcaaucag

SEQ ID NO: 2900 - RNA, 22 nt, Homo Sapiens
auuauaaagagaagagcaauca

SEQ ID NO: 2901 - RNA, 25 nt, Homo Sapiens
cauuucuauguaaauuagcaaucag

SEQ ID NO: 2902 - RNA, 17 nt, Homo Sapiens
cauuaaaaaaugagcaa

SEQ ID NO: 2903 - RNA, 17 nt, Homo Sapiens
cauuuucaaaugagcaa

SEQ ID NO: 2904 - RNA, 21 nt, Homo Sapiens
cauuuacccuuuugagcaauc

SEQ ID NO: 2905 - RNA, 22 nt, Homo Sapiens
cauuuaaacgaggcaguuauca

SEQ ID NO: 2906 - RNA, 19 nt, Homo Sapiens
cuguucauaaguuuauuau

SEQ ID NO: 2907 - RNA, 20 nt, Homo Sapiens
uaauaagcauuagcaaucag

SEQ ID NO: 2908 - RNA, 23 nt, Homo Sapiens
ucaguaucauauguuagagauga

SEQ ID NO: 2909 - RNA, 23 nt, Homo Sapiens
ucuucucauauguugcuguagga

SEQ ID NO: 2910 - RNA, 19 nt, Homo Sapiens
ucuguucauaauuuuauga

SEQ ID NO: 2911 - RNA, 22 nt, Homo Sapiens
ucuguucuuaaaaugguuauga

SEQ ID NO: 2912 - RNA, 22 nt, Homo Sapiens
ugucuagguccuuuguugguua

SEQ ID NO: 2913 - RNA, 22 nt, Homo Sapiens
ugucuguucauuuggcuuguua

SEQ ID NO: 2914 - RNA, 19 nt, Homo Sapiens
ugucuguucaugggucugg

SEQ ID NO: 2915 - RNA, 22 nt, Homo Sapiens
ugucuguucacaucucugugau

SEQ ID NO: 2916 - RNA, 21 nt, Homo Sapiens
ugucugcauggaugguuauga

SEQ ID NO: 2917 - RNA, 20 nt, Homo Sapiens
ugucaauauccugguuauga

SEQ ID NO: 2918 - RNA, 21 nt, Homo Sapiens
uucacuauguuggucacuaug

SEQ ID NO: 2919 - RNA, 19 nt, Homo Sapiens
uuuuuacgaaugaggcaau

SEQ ID NO: 2920 - RNA, 18 nt, Homo Sapiens
uucaaaaaugagcaacca

SEQ ID NO: 2921 - RNA, 68 nt, Homo Sapiens
cugugaacagagaggccaugggaagauucgaaauuauucacgaaaaauccuaagauuucaguucagag

SEQ ID NO: 2922 - RNA, 24 nt, Homo Sapiens
ugaacagagaggccaugggaagau

SEQ ID NO: 2923 - RNA, 23 nt, Homo Sapiens
aacaggaaagcaccaugggaaga

SEQ ID NO: 2924 - RNA, 20 nt, Homo Sapiens
aacauucaggccauggcaag

SEQ ID NO: 2925 - RNA, 21 nt, Homo Sapiens
aacugagggccaugggcugau

SEQ ID NO: 2926 - RNA, 20 nt, Homo Sapiens
acagaaauggccaugggaag

SEQ ID NO: 2927 - RNA, 19 nt, Homo Sapiens
acagagagggauguggaga

SEQ ID NO: 2928 - RNA, 19 nt, Homo Sapiens
acaagaugccugggaagau

SEQ ID NO: 2929 - RNA, 19 nt, Homo Sapiens
agagcggcaucaugggaag

SEQ ID NO: 2930 - RNA, 19 nt, Homo Sapiens
agggaaucccugggaagau

SEQ ID NO: 2931 - RNA, 19 nt, Homo Sapiens
agaggccaacaugggaaga

SEQ ID NO: 2932 - RNA, 19 nt, Homo Sapiens
gaacagagaugaccauggg

SEQ ID NO: 2933 - RNA, 19 nt, Homo Sapiens
gaacagagauggccuggga

SEQ ID NO: 2934 - RNA, 19 nt, Homo Sapiens
gagcagagaggcgaggcga

SEQ ID NO: 2935 - RNA, 21 nt, Homo Sapiens
gaacagaacagaaugggaaga

SEQ ID NO: 2936 - RNA, 21 nt, Homo Sapiens
gaacauagagggugggaagau

SEQ ID NO: 2937 - RNA, 24 nt, Homo Sapiens
ugaacagagccacucccuggaaag

SEQ ID NO: 2938 - RNA, 23 nt, Homo Sapiens
ugaacagagacaggcaugggaag

SEQ ID NO: 2939 - RNA, 23 nt, Homo Sapiens
uguacagagaggccaaggggaag

SEQ ID NO: 2940 - RNA, 19 nt, Homo Sapiens
ugcacagagaggcuguggg

SEQ ID NO: 2941 - RNA, 17 nt, Homo Sapiens
ugaacagagcuugggaa

SEQ ID NO: 2942 - RNA, 19 nt, Homo Sapiens
uggacagagaggaugggaa

SEQ ID NO: 2943 - RNA, 19 nt, Homo Sapiens
ugaacagagagucaagaag

SEQ ID NO: 2944 - RNA, 22 nt, Homo Sapiens
ugaccagaaugcaugggaagau

SEQ ID NO: 2945 - RNA, 24 nt, Homo Sapiens
ugagcaaagcugcugugggaagau

SEQ ID NO: 2946 - RNA, 67 nt, Homo Sapiens
cugugauggcgcaauuaacguuuccuagccucccauguaauccuaggacguguacgcuucgucagag

SEQ ID NO: 2947 - RNA, 24 nt, Homo Sapiens
ugugauggcgcaauuaacguuucc

SEQ ID NO: 2948 - RNA, 20 nt, Homo Sapiens
ugguggcugacaauuaacgu

SEQ ID NO: 2949 - RNA, 20 nt, Homo Sapiens
ugugauggcgauagcaauua

SEQ ID NO: 2950 - RNA, 20 nt, Homo Sapiens
ugugauggcugcuucuuaac

SEQ ID NO: 2951 - RNA, 18 nt, Homo Sapiens
ugugauggccaucaaugu

SEQ ID NO: 2952 - RNA, 20 nt, Homo Sapiens
ugugauggccgaguugaggu

SEQ ID NO: 2953 - RNA, 69 nt, Homo Sapiens
cuguggaccacuguuucuccaucaaaggccuaagggcacugugagugacaggggaccaguccuuugcag

SEQ ID NO: 2954 - RNA, 24 nt, Homo Sapiens
ugugagugacaggggaccaguccu

SEQ ID NO: 2955 - RNA, 18 nt, Homo Sapiens
agggacaggggacagccc

SEQ ID NO: 2956 - RNA, 18 nt, Homo Sapiens
agugacagggcccaggcc

SEQ ID NO: 2957 - RNA, 17 nt, Homo Sapiens
gagugacagggcagccc

SEQ ID NO: 2958 - RNA, 19 nt, Homo Sapiens
gaggggcaggggaccuccu

SEQ ID NO: 2959 - RNA, 23 nt, Homo Sapiens
gugagugugauggggggaccagu

SEQ ID NO: 2960 - RNA, 22 nt, Homo Sapiens
gugagugacaggaggucaccag

SEQ ID NO: 2961 - RNA, 19 nt, Homo Sapiens
gugacgacaggggacaguc

SEQ ID NO: 2962 - RNA, 20 nt, Homo Sapiens
gugagugacgggaacauguc

SEQ ID NO: 2963 - RNA, 19 nt, Homo Sapiens
ugaggaugacaggggccag

SEQ ID NO: 2964 - RNA, 19 nt, Homo Sapiens
ugaggugacagggcagcca

SEQ ID NO: 2965 - RNA, 17 nt, Homo Sapiens
ugggugcagggaccagu

SEQ ID NO: 2966 - RNA, 21 nt, Homo Sapiens
ugucacugaggaggggaccag

SEQ ID NO: 2967 - RNA, 62 nt, Homo Sapiens
cuguguucuggcggccccauucguagccacugggggucagcuuguaggccgucaguguacag

SEQ ID NO: 2968 - RNA, 24 nt, Homo Sapiens
uguucuggcggccccauucguagc

SEQ ID NO: 2969 - RNA, 19 nt, Homo Sapiens
cuggcggccggccagacgu

SEQ ID NO: 2970 - RNA, 25 nt, Homo Sapiens
guucuggcgagcacaacuacguugc

SEQ ID NO: 2971 - RNA, 20 nt, Homo Sapiens
ucugcccugggccccauucg

SEQ ID NO: 2972 - RNA, 22 nt, Homo Sapiens
uguucuggcggcaaacccucgu

SEQ ID NO: 2973 - RNA, 116 nt, Homo Sapiens
cuguugguucuuucuccugacuccugugguuuugcuaauggcacuuuacagacuccauggagaugucagguggaccaucuucuagggcccagcaggaguagggaaugugccaacag

SEQ ID NO: 2974 - RNA, 24 nt, Homo Sapiens
ugucagguggaccaucuucuaggg

SEQ ID NO: 2975 - RNA, 21 nt, Homo Sapiens
acauuacagacucacuuggag

SEQ ID NO: 2976 - RNA, 19 nt, Homo Sapiens
agguggaccugucuucaag

SEQ ID NO: 2977 - RNA, 19 nt, Homo Sapiens
cacuuucacaagacuccau

SEQ ID NO: 2978 - RNA, 20 nt, Homo Sapiens
cacuuuauuuggacuccaug

SEQ ID NO: 2979 - RNA, 19 nt, Homo Sapiens
cacuuuacagacucucugg

SEQ ID NO: 2980 - RNA, 20 nt, Homo Sapiens
cacuuagcaacuccauggag

SEQ ID NO: 2981 - RNA, 20 nt, Homo Sapiens
cacuuuacaauuucagugag

SEQ ID NO: 2982 - RNA, 21 nt, Homo Sapiens
cacuuuacagccucacugcag

SEQ ID NO: 2983 - RNA, 18 nt, Homo Sapiens
cagguggacaucucuggg

SEQ ID NO: 2984 - RNA, 19 nt, Homo Sapiens
cuuugcacaacuccaugga

SEQ ID NO: 2985 - RNA, 25 nt, Homo Sapiens
gcacuguuuauccaggcuccaugga

SEQ ID NO: 2986 - RNA, 19 nt, Homo Sapiens
gcccuucuaugacuccaug

SEQ ID NO: 2987 - RNA, 21 nt, Homo Sapiens
gcacuuuacauuccauaggag

SEQ ID NO: 2988 - RNA, 25 nt, Homo Sapiens
ggaauuuuacaaacauuccauggag

SEQ ID NO: 2989 - RNA, 19 nt, Homo Sapiens
ggcacuuuacgguuuucau

SEQ ID NO: 2990 - RNA, 23 nt, Homo Sapiens
gucagucuguggccaccaucuuc

SEQ ID NO: 2991 - RNA, 23 nt, Homo Sapiens
gucagguggcugccgucuuccag

SEQ ID NO: 2992 - RNA, 20 nt, Homo Sapiens
gucacauccaucaucuucua

SEQ ID NO: 2993 - RNA, 22 nt, Homo Sapiens
uggcacuuuggcagaacccucc

SEQ ID NO: 2994 - RNA, 24 nt, Homo Sapiens
uggacuugagaggccuccauggag

SEQ ID NO: 2995 - RNA, 18 nt, Homo Sapiens
uggacuaugcagacucca

SEQ ID NO: 2996 - RNA, 20 nt, Homo Sapiens
ugucucuaaacagacuccau

SEQ ID NO: 2997 - RNA, 23 nt, Homo Sapiens
uggcucagaagagacuccaugga

SEQ ID NO: 2998 - RNA, 26 nt, Homo Sapiens
uguacagaguggaccaucuuaugagg

SEQ ID NO: 2999 - RNA, 23 nt, Homo Sapiens
ugucagguggaaauccauuugcu

SEQ ID NO: 3000 - RNA, 18 nt, Homo Sapiens
uguagauggccaucuucu

SEQ ID NO: 3001 - RNA, 20 nt, Homo Sapiens
ugucaggugcaucugcuucu

SEQ ID NO: 3002 - RNA, 20 nt, Homo Sapiens
ugucagguggcucuccucua

SEQ ID NO: 3003 - RNA, 20 nt, Homo Sapiens
uuacaaauuccuccauggag

SEQ ID NO: 3004 - RNA, 67 nt, Homo Sapiens
cuuagggaggaaggacuaggagggaaaacugggaaaacguacggugggcucugucuugcgucuugag

SEQ ID NO: 3005 - RNA, 24 nt, Homo Sapiens
uuagggaggaaggacuaggaggga

SEQ ID NO: 3006 - RNA, 23 nt, Homo Sapiens
aggagaggaaggaagagaagaga

SEQ ID NO: 3007 - RNA, 19 nt, Homo Sapiens
agggaggaagagggaggga

SEQ ID NO: 3008 - RNA, 20 nt, Homo Sapiens
agggaggaagagcagaggga

SEQ ID NO: 3009 - RNA, 17 nt, Homo Sapiens
agggaggaagggaggga

SEQ ID NO: 3010 - RNA, 20 nt, Homo Sapiens
agggaggaaggagggaggga

SEQ ID NO: 3011 - RNA, 21 nt, Homo Sapiens
agggaggaaggaagggaugga

SEQ ID NO: 3012 - RNA, 21 nt, Homo Sapiens
ggaggaagguaccgggagaga

SEQ ID NO: 3013 - RNA, 17 nt, Homo Sapiens
gggaggaaggcaggagg

SEQ ID NO: 3014 - RNA, 19 nt, Homo Sapiens
gggaggaaggucagggagg

SEQ ID NO: 3015 - RNA, 20 nt, Homo Sapiens
gggaggaagggggaggaagg

SEQ ID NO: 3016 - RNA, 16 nt, Homo Sapiens
gggaggaagggaggga

SEQ ID NO: 3017 - RNA, 17 nt, Homo Sapiens
gggaggaagaggaggga

SEQ ID NO: 3018 - RNA, 22 nt, Homo Sapiens
uagggaggagagacuugaugga

SEQ ID NO: 3019 - RNA, 30 nt, Homo Sapiens
uuaggguagagugaaggaguauaggaggga

SEQ ID NO: 3020 - RNA, 19 nt, Homo Sapiens
uuagguagaaacuaggagg

SEQ ID NO: 3021 - RNA, 71 nt, Homo Sapiens
cuucagcaaugucaguaaaaugaucuuccgaugcugacgccagcauuuucccaucauggcugaaacugagg

SEQ ID NO: 3022 - RNA, 24 nt, Homo Sapiens
ugucaguaaaaugaucuuccgaug

SEQ ID NO: 3023 - RNA, 21 nt, Homo Sapiens
aguaauaaaugaucuuccaug

SEQ ID NO: 3024 - RNA, 19 nt, Homo Sapiens
guagaaugaucuugggaug

SEQ ID NO: 3025 - RNA, 21 nt, Homo Sapiens
gucacuuaaacaugaucuucc

SEQ ID NO: 3026 - RNA, 19 nt, Homo Sapiens
gucacuauuaugaucuucc

SEQ ID NO: 3027 - RNA, 19 nt, Homo Sapiens
ucaguaaaagugggcuccg

SEQ ID NO: 3028 - RNA, 23 nt, Homo Sapiens
ucaaaaaaaugaucaucacggug

SEQ ID NO: 3029 - RNA, 18 nt, Homo Sapiens
ugucaguaaauaaucuuc

SEQ ID NO: 3030 - RNA, 76 nt, Homo Sapiens
gaaaauauaagaacauucuagaagguugugagacauaagguacaaaaaccuucuagcauaauuucaaaaaauuuuc

SEQ ID NO: 3031 - RNA, 24 nt, Homo Sapiens
uaagaacauucuagaagguuguga

SEQ ID NO: 3032 - RNA, 18 nt, Homo Sapiens
aagaacauucaaaauguu

SEQ ID NO: 3033 - RNA, 24 nt, Homo Sapiens
aaaaacaugagagaagguugauga

SEQ ID NO: 3034 - RNA, 22 nt, Homo Sapiens
aagaacauuguucaaaggugug

SEQ ID NO: 3035 - RNA, 21 nt, Homo Sapiens
aagaacauucaaaaauuguga

SEQ ID NO: 3036 - RNA, 22 nt, Homo Sapiens
agaacacuaggcaagaagguug

SEQ ID NO: 3037 - RNA, 20 nt, Homo Sapiens
gaacauucuaagaagcuggu

SEQ ID NO: 3038 - RNA, 20 nt, Homo Sapiens
gaacauucuaguuuaagauu

SEQ ID NO: 3039 - RNA, 23 nt, Homo Sapiens
uaagaacauucucugacagguug

SEQ ID NO: 3040 - RNA, 19 nt, Homo Sapiens
uaagaacauucuagcaggu

SEQ ID NO: 3041 - RNA, 20 nt, Homo Sapiens
uaagaacaucuggaaauugu

SEQ ID NO: 3042 - RNA, 20 nt, Homo Sapiens
uaagaacauuagaugccugu

SEQ ID NO: 3043 - RNA, 74 nt, Homo Sapiens
gaaaugaggucggguuuauaugcacuuauugguauuggaauuucuggugcaacuuauagguuugauuuuaauuu

SEQ ID NO: 3044 - RNA, 24 nt, Homo Sapiens
ugaggucggguuuauaugcacuua

SEQ ID NO: 3045 - RNA, 18 nt, Homo Sapiens
agaucgguuuauauacac

SEQ ID NO: 3046 - RNA, 21 nt, Homo Sapiens
aggucggguuauuuuguucuu

SEQ ID NO: 3047 - RNA, 24 nt, Homo Sapiens
ugaguuaggcuauuauaugcaauu

SEQ ID NO: 3048 - RNA, 22 nt, Homo Sapiens
ugaaguaggacauauaugcacu

SEQ ID NO: 3049 - RNA, 74 nt, Homo Sapiens
gaagacaaauugaagggagagaugauggaucuccaacauggcagccuuuuccuuagaacaccaaagauugucuc

SEQ ID NO: 3050 - RNA, 24 nt, Homo Sapiens
uggcagccuuuuccuuagaacacc

SEQ ID NO: 3051 - RNA, 20 nt, Homo Sapiens
cagacuuaauuuccuuagaa

SEQ ID NO: 3052 - RNA, 17 nt, Homo Sapiens
caaccuuuuccugaaca

SEQ ID NO: 3053 - RNA, 19 nt, Homo Sapiens
cccuuuccuuagcaacccc

SEQ ID NO: 3054 - RNA, 19 nt, Homo Sapiens
ccuuuuccuagaauccacc

SEQ ID NO: 3055 - RNA, 21 nt, Homo Sapiens
gcaccucuuuuccuuugcaca

SEQ ID NO: 3056 - RNA, 19 nt, Homo Sapiens
gcagccuuucccucgagaa

SEQ ID NO: 3057 - RNA, 22 nt, Homo Sapiens
gcagccuuucacugagagacac

SEQ ID NO: 3058 - RNA, 19 nt, Homo Sapiens
gcugcauuucuuagaacac

SEQ ID NO: 3059 - RNA, 21 nt, Homo Sapiens
ggaagcaucauuuccuuagaa

SEQ ID NO: 3060 - RNA, 25 nt, Homo Sapiens
ggcagccuuuuacaaugagaaacac

SEQ ID NO: 3061 - RNA, 17 nt, Homo Sapiens
ggcagucuuccuuagaa

SEQ ID NO: 3062 - RNA, 27 nt, Homo Sapiens
ugggagacguuuuucugguagaacacc

SEQ ID NO: 3063 - RNA, 20 nt, Homo Sapiens
uggcagccuccuaaccuuag

SEQ ID NO: 3064 - RNA, 22 nt, Homo Sapiens
uggcagccuggguagcuuagaa

SEQ ID NO: 3065 - RNA, 19 nt, Homo Sapiens
uggcaguuuccuuaguaac

SEQ ID NO: 3066 - RNA, 19 nt, Homo Sapiens
ugucagccuuuucuuugga

SEQ ID NO: 3067 - RNA, 22 nt, Homo Sapiens
uggcagccucuccuaggagaca

SEQ ID NO: 3068 - RNA, 22 nt, Homo Sapiens
uggagccuuuucccuauaccac

SEQ ID NO: 3069 - RNA, 63 nt, Homo Sapiens
gaagcuguccgcauuuauguggcaucgguccaagcaucccugggccagucgugcgacagacuc

SEQ ID NO: 3070 - RNA, 24 nt, Homo Sapiens
uguccgcauuuauguggcaucggu

SEQ ID NO: 3071 - RNA, 21 nt, Homo Sapiens
ccccuuuucagaggcaucggu

SEQ ID NO: 3072 - RNA, 24 nt, Homo Sapiens
guccagcaguuaguuuguggcauc

SEQ ID NO: 3073 - RNA, 19 nt, Homo Sapiens
gucagccagcuauguggca

SEQ ID NO: 3074 - RNA, 21 nt, Homo Sapiens
ugugggcacuccuguggcauc

SEQ ID NO: 3075 - RNA, 65 nt, Homo Sapiens
gaauccagauggcaugguugcucuauuggacuaccgugaggauggugugaccccauauaugauuu

SEQ ID NO: 3076 - RNA, 24 nt, Homo Sapiens
uggcaugguugcucuauuggacua

SEQ ID NO: 3077 - RNA, 19 nt, Homo Sapiens
gcuugguugcucuggagua

SEQ ID NO: 3078 - RNA, 20 nt, Homo Sapiens
ggcuaugguugcuaagcuau

SEQ ID NO: 3079 - RNA, 22 nt, Homo Sapiens
ggcaugguucaggcuuuacugg

SEQ ID NO: 3080 - RNA, 26 nt, Homo Sapiens
uggcaugguccuagcugcauugagac

SEQ ID NO: 3081 - RNA, 63 nt, Homo Sapiens
gaaugagcugcuaaauccugaagaugaccucuuaccagggaagauucgagacagcaaucguuc

SEQ ID NO: 3082 - RNA, 24 nt, Homo Sapiens
ugagcugcuaaauccugaagauga

SEQ ID NO: 3083 - RNA, 24 nt, Homo Sapiens
agauguuaaaagugccugaagaug

SEQ ID NO: 3084 - RNA, 22 nt, Homo Sapiens
agcugcuucuuuaccugaagau

SEQ ID NO: 3085 - RNA, 21 nt, Homo Sapiens
agcucacaauccugaaggaug

SEQ ID NO: 3086 - RNA, 21 nt, Homo Sapiens
cugccaauaugccugaagaug

SEQ ID NO: 3087 - RNA, 20 nt, Homo Sapiens
cugcuuacuguccugaagau

SEQ ID NO: 3088 - RNA, 18 nt, Homo Sapiens
cuguuauaccugaagaug

SEQ ID NO: 3089 - RNA, 18 nt, Homo Sapiens
cuucuaaauccucaaaug

SEQ ID NO: 3090 - RNA, 24 nt, Homo Sapiens
gcuucuaaaaauuacugaagauga

SEQ ID NO: 3091 - RNA, 22 nt, Homo Sapiens
gcugcuaaaguccaugcaagau

SEQ ID NO: 3092 - RNA, 21 nt, Homo Sapiens
gcuggaaaacgcugaagauga

SEQ ID NO: 3093 - RNA, 21 nt, Homo Sapiens
gcuggaaaaugcugaagauga

SEQ ID NO: 3094 - RNA, 19 nt, Homo Sapiens
gcugguagacugaagauga

SEQ ID NO: 3095 - RNA, 19 nt, Homo Sapiens
ugagcugcugggaaaccug

SEQ ID NO: 3096 - RNA, 24 nt, Homo Sapiens
ugagcugcucaaugaccuggaaga

SEQ ID NO: 3097 - RNA, 19 nt, Homo Sapiens
ugagaagaaaaauccugaa

SEQ ID NO: 3098 - RNA, 18 nt, Homo Sapiens
ugagcuuucauccugaag

SEQ ID NO: 3099 - RNA, 22 nt, Homo Sapiens
ugagcugcuuuucuugaaguug

SEQ ID NO: 3100 - RNA, 19 nt, Homo Sapiens
ugagcugcuaagaagauga

SEQ ID NO: 3101 - RNA, 86 nt, Homo Sapiens
gaauucugaucauaccaguuuccaucaggauuuaucagaucugaaacauccugcagauaagcugguugacaaucccacagcaguuc

SEQ ID NO: 3102 - RNA, 24 nt, Homo Sapiens
uaccaguuuccaucaggauuuauc

SEQ ID NO: 3103 - RNA, 18 nt, Homo Sapiens
accaguuucaauaguauu

SEQ ID NO: 3104 - RNA, 19 nt, Homo Sapiens
accaguuucacucaguuua

SEQ ID NO: 3105 - RNA, 20 nt, Homo Sapiens
agucuccaaaaucaggauuu

SEQ ID NO: 3106 - RNA, 19 nt, Homo Sapiens
aguuuccauaaagauauua

SEQ ID NO: 3107 - RNA, 17 nt, Homo Sapiens
aguuuccaucacuuuau

SEQ ID NO: 3108 - RNA, 19 nt, Homo Sapiens
ccaguuuccccaucacgau

SEQ ID NO: 3109 - RNA, 24 nt, Homo Sapiens
ccaguuuccacuguccggcuugau

SEQ ID NO: 3110 - RNA, 19 nt, Homo Sapiens
ccaguuuccaacucaugau

SEQ ID NO: 3111 - RNA, 18 nt, Homo Sapiens
ccaguuuccucaguuuuu

SEQ ID NO: 3112 - RNA, 18 nt, Homo Sapiens
guuugcucaggauuuuuc

SEQ ID NO: 3113 - RNA, 25 nt, Homo Sapiens
uaccacuuucacuuaaucaggauuu

SEQ ID NO: 3114 - RNA, 23 nt, Homo Sapiens
uaccaguuuugaucaguuggauu

SEQ ID NO: 3115 - RNA, 21 nt, Homo Sapiens
uaacaguuuauuaggauuuau

SEQ ID NO: 3116 - RNA, 23 nt, Homo Sapiens
uagcaguuaaaaucaggauucau

SEQ ID NO: 3117 - RNA, 20 nt, Homo Sapiens
uuuacauuuacaggauuuau

SEQ ID NO: 3118 - RNA, 84 nt, Homo Sapiens
gacaccgguguccuuccucgaguaaccgaccuuccaguuccagcccuccaagucccacggcucggaagagcgacuaccaucguc

SEQ ID NO: 3119 - RNA, 24 nt, Homo Sapiens
uccaagucccacggcucggaagag

SEQ ID NO: 3120 - RNA, 19 nt, Homo Sapiens
aagucccacugcucuggag

SEQ ID NO: 3121 - RNA, 19 nt, Homo Sapiens
aacuccccggcucggagga

SEQ ID NO: 3122 - RNA, 24 nt, Homo Sapiens
caauugcccacggcucaacaagag

SEQ ID NO: 3123 - RNA, 22 nt, Homo Sapiens
caagucccagacauuggaggag

SEQ ID NO: 3124 - RNA, 18 nt, Homo Sapiens
caagucccacguggaaga

SEQ ID NO: 3125 - RNA, 20 nt, Homo Sapiens
caagucccagacucugagag

SEQ ID NO: 3126 - RNA, 21 nt, Homo Sapiens
ccaagucccaacguugcacgg

SEQ ID NO: 3127 - RNA, 20 nt, Homo Sapiens
ccaagucccagccagccgga

SEQ ID NO: 3128 - RNA, 24 nt, Homo Sapiens
ccaagucccaggucugucuggaag

SEQ ID NO: 3129 - RNA, 26 nt, Homo Sapiens
uccaagucccacucugcuuugaagag

SEQ ID NO: 3130 - RNA, 24 nt, Homo Sapiens
uccaagucccuugagccagaugag

SEQ ID NO: 3131 - RNA, 21 nt, Homo Sapiens
uccucggcgcucggcucggaa

SEQ ID NO: 3132 - RNA, 60 nt, Homo Sapiens
gacccggggcuggacgccagccucugugaugaguucuggcuguguccacgcuccuggcuc

SEQ ID NO: 3133 - RNA, 24 nt, Homo Sapiens
uggcuguguccacgcuccuggcuc

SEQ ID NO: 3134 - RNA, 29 nt, Homo Sapiens
acccggcacaggccauugacgccagccuc

SEQ ID NO: 3135 - RNA, 22 nt, Homo Sapiens
acccgggggcuggacccggccu

SEQ ID NO: 3136 - RNA, 26 nt, Homo Sapiens
accccggcugcuccccgccagccucu

SEQ ID NO: 3137 - RNA, 21 nt, Homo Sapiens
acccggggcugcagggacgcc

SEQ ID NO: 3138 - RNA, 24 nt, Homo Sapiens
acccggggcucggagccccacccu

SEQ ID NO: 3139 - RNA, 23 nt, Homo Sapiens
acccggggcuaugacaccccccu

SEQ ID NO: 3140 - RNA, 24 nt, Homo Sapiens
acccggggcugccacgcccccucu

SEQ ID NO: 3141 - RNA, 23 nt, Homo Sapiens
acccggggccccaccccaggccu

SEQ ID NO: 3142 - RNA, 22 nt, Homo Sapiens
acacgggccucacccagccucu

SEQ ID NO: 3143 - RNA, 22 nt, Homo Sapiens
cccggggcuccaggccgcccgc

SEQ ID NO: 3144 - RNA, 24 nt, Homo Sapiens
cccggggcucgggcgacgcagccu

SEQ ID NO: 3145 - RNA, 23 nt, Homo Sapiens
cccggggcucgcaagccaguccu

SEQ ID NO: 3146 - RNA, 23 nt, Homo Sapiens
cccggggcuggggcgcggacucu

SEQ ID NO: 3147 - RNA, 20 nt, Homo Sapiens
cccggggcugagacggcgcc

SEQ ID NO: 3148 - RNA, 21 nt, Homo Sapiens
cccggggcugcaccggcugcc

SEQ ID NO: 3149 - RNA, 18 nt, Homo Sapiens
ccaggggcuggagcccgc

SEQ ID NO: 3150 - RNA, 19 nt, Homo Sapiens
cccggggcuggaccacagc

SEQ ID NO: 3151 - RNA, 19 nt, Homo Sapiens
cccggguuuggacgccagc

SEQ ID NO: 3152 - RNA, 20 nt, Homo Sapiens
cccggggcucgcggccggcc

SEQ ID NO: 3153 - RNA, 20 nt, Homo Sapiens
cccugagcuggacgcuaacc

SEQ ID NO: 3154 - RNA, 21 nt, Homo Sapiens
cccggggcucggcuaggcucu

SEQ ID NO: 3155 - RNA, 22 nt, Homo Sapiens
ccgggucacgugaacgccagcc

SEQ ID NO: 3156 - RNA, 19 nt, Homo Sapiens
ccggggcuggcgagcagcc

SEQ ID NO: 3157 - RNA, 23 nt, Homo Sapiens
cccgggcuggacgcacggccgcu

SEQ ID NO: 3158 - RNA, 21 nt, Homo Sapiens
ccggggcugggggccggagcc

SEQ ID NO: 3159 - RNA, 17 nt, Homo Sapiens
ccggggcugggacagcc

SEQ ID NO: 3160 - RNA, 19 nt, Homo Sapiens
ccggggcugggcugccucu

SEQ ID NO: 3161 - RNA, 22 nt, Homo Sapiens
cggggcuggcucgcacugccuc

SEQ ID NO: 3162 - RNA, 22 nt, Homo Sapiens
cggggccggcccccgccagccu

SEQ ID NO: 3163 - RNA, 20 nt, Homo Sapiens
cugggcucccagcuccuggc

SEQ ID NO: 3164 - RNA, 19 nt, Homo Sapiens
cucuuucccucuccuggcu

SEQ ID NO: 3165 - RNA, 19 nt, Homo Sapiens
cugagucagacuccuggcu

SEQ ID NO: 3166 - RNA, 22 nt, Homo Sapiens
ggcucuagaccacuccuggcuc

SEQ ID NO: 3167 - RNA, 20 nt, Homo Sapiens
ggcugugucaccacacuccu

SEQ ID NO: 3168 - RNA, 26 nt, Homo Sapiens
ggccgugucccccugcccuccuggcu

SEQ ID NO: 3169 - RNA, 21 nt, Homo Sapiens
gggguggagcccccagccucu

SEQ ID NO: 3170 - RNA, 24 nt, Homo Sapiens
uggccgguccgggccuccuggcuc

SEQ ID NO: 3171 - RNA, 18 nt, Homo Sapiens
uggcugggccacgcuccu

SEQ ID NO: 3172 - RNA, 62 nt, Homo Sapiens
gacuauggcaaggaccugauggagaaggucaagagcccagagcuucaggccgaggccaaguc

SEQ ID NO: 3173 - RNA, 24 nt, Homo Sapiens
uggcaaggaccugauggagaaggu

SEQ ID NO: 3174 - RNA, 23 nt, Homo Sapiens
aaggucaccaguaaggagaaggu

SEQ ID NO: 3175 - RNA, 22 nt, Homo Sapiens
aaggaccuggggcgagagaagg

SEQ ID NO: 3176 - RNA, 19 nt, Homo Sapiens
aaggaucugauggaggagg

SEQ ID NO: 3177 - RNA, 20 nt, Homo Sapiens
aaggaccuggugguguaugu

SEQ ID NO: 3178 - RNA, 21 nt, Homo Sapiens
aggaagcccugcuggagaagg

SEQ ID NO: 3179 - RNA, 20 nt, Homo Sapiens
caaggugaacugauggagaa

SEQ ID NO: 3180 - RNA, 20 nt, Homo Sapiens
cagggaccuggauggagaag

SEQ ID NO: 3181 - RNA, 20 nt, Homo Sapiens
gcaaggacccagauggggaa

SEQ ID NO: 3182 - RNA, 19 nt, Homo Sapiens
gccaggaccugaggaggag

SEQ ID NO: 3183 - RNA, 21 nt, Homo Sapiens
gcaaauaucugguggagaagg

SEQ ID NO: 3184 - RNA, 19 nt, Homo Sapiens
gcaagcgagauggagaagg

SEQ ID NO: 3185 - RNA, 18 nt, Homo Sapiens
gcaagggccuggagaagg

SEQ ID NO: 3186 - RNA, 20 nt, Homo Sapiens
ggacacugggauggagaagg

SEQ ID NO: 3187 - RNA, 21 nt, Homo Sapiens
ggcagaggccugggagaaggu

SEQ ID NO: 3188 - RNA, 23 nt, Homo Sapiens
ggcuagugcccugauggaaaggu

SEQ ID NO: 3189 - RNA, 23 nt, Homo Sapiens
gggauggaaccugauggaaacgu

SEQ ID NO: 3190 - RNA, 22 nt, Homo Sapiens
ggaaaggaccuggaugagaggg

SEQ ID NO: 3191 - RNA, 24 nt, Homo Sapiens
ggaaaggaccugcgcugaaaaggu

SEQ ID NO: 3192 - RNA, 18 nt, Homo Sapiens
ggcaaggacggagggaga

SEQ ID NO: 3193 - RNA, 19 nt, Homo Sapiens
ggcaaggacgugcuaggga

SEQ ID NO: 3194 - RNA, 17 nt, Homo Sapiens
ggcaaggacauggggaa

SEQ ID NO: 3195 - RNA, 20 nt, Homo Sapiens
ggcagggaggggauggagaa

SEQ ID NO: 3196 - RNA, 19 nt, Homo Sapiens
ggcaacuuguuggagaagg

SEQ ID NO: 3197 - RNA, 20 nt, Homo Sapiens
gggaaagacuauggagaagg

SEQ ID NO: 3198 - RNA, 23 nt, Homo Sapiens
ggaaagaagaugauggagaaagu

SEQ ID NO: 3199 - RNA, 23 nt, Homo Sapiens
uggcaaaggaccugccuggaaaa

SEQ ID NO: 3200 - RNA, 22 nt, Homo Sapiens
ugggagagggcgauggagaagg

SEQ ID NO: 3201 - RNA, 19 nt, Homo Sapiens
uggcaaggacagugaagga

SEQ ID NO: 3202 - RNA, 21 nt, Homo Sapiens
uggcaagaaacagauggagaa

SEQ ID NO: 3203 - RNA, 22 nt, Homo Sapiens
uggcaggagugagggagaaggu

SEQ ID NO: 3204 - RNA, 82 nt, Homo Sapiens
gacugaaggaggaauaucagucccuuauccgguauguggagaacaacaagaaugcugacaacgauugguuccgacuggaguc

SEQ ID NO: 3205 - RNA, 24 nt, Homo Sapiens
uaucagucccuuauccgguaugug

SEQ ID NO: 3206 - RNA, 20 nt, Homo Sapiens
aucaagucccuuaucaagua

SEQ ID NO: 3207 - RNA, 19 nt, Homo Sapiens
aucagucccacuccggaau

SEQ ID NO: 3208 - RNA, 21 nt, Homo Sapiens
aucagucccauaucugcaaug

SEQ ID NO: 3209 - RNA, 21 nt, Homo Sapiens
gucccuuauucaggaauagug

SEQ ID NO: 3210 - RNA, 82 nt, Homo Sapiens
gacuucaggcaaaucauuuauuuuuuggggcaucagugucacaaacuauaacaucagagaauaaaccaaaugaccucauguc

SEQ ID NO: 3211 - RNA, 24 nt, Homo Sapiens
uaacaucagagaauaaaccaaaug

SEQ ID NO: 3212 - RNA, 26 nt, Homo Sapiens
aacauuugacagacaaguaaaccaaa

SEQ ID NO: 3213 - RNA, 25 nt, Homo Sapiens
aacaucagacccugaguaaaccaaa

SEQ ID NO: 3214 - RNA, 26 nt, Homo Sapiens
aacaucagacuuaaauagaccauaug

SEQ ID NO: 3215 - RNA, 25 nt, Homo Sapiens
aacauuuaaaaauuaaaaccaaaug

SEQ ID NO: 3216 - RNA, 22 nt, Homo Sapiens
aaaaucagagaaaaacaaccaa

SEQ ID NO: 3217 - RNA, 26 nt, Homo Sapiens
aacaucagaagacaaacaaacaaaug

SEQ ID NO: 3218 - RNA, 15 nt, Homo Sapiens
aacaucagaaaacca

SEQ ID NO: 3219 - RNA, 20 nt, Homo Sapiens
aagaacacaaaauaaaccaa

SEQ ID NO: 3220 - RNA, 22 nt, Homo Sapiens
aacuucacacagaaaaccaaau

SEQ ID NO: 3221 - RNA, 21 nt, Homo Sapiens
aacuacugagaauaaacaaug

SEQ ID NO: 3222 - RNA, 26 nt, Homo Sapiens
acauggagagaauaaagcagagaaug

SEQ ID NO: 3223 - RNA, 24 nt, Homo Sapiens
acaucagagaacauuugaaccaaa

SEQ ID NO: 3224 - RNA, 21 nt, Homo Sapiens
acaucagagaacaaaaccaaa

SEQ ID NO: 3225 - RNA, 22 nt, Homo Sapiens
acaugaaagaauaaaaccaaau

SEQ ID NO: 3226 - RNA, 19 nt, Homo Sapiens
acaucagagaauguagcaa

SEQ ID NO: 3227 - RNA, 20 nt, Homo Sapiens
acagcaccgcauaaaccaaa

SEQ ID NO: 3228 - RNA, 20 nt, Homo Sapiens
acauuaaagaauaaaccaaa

SEQ ID NO: 3229 - RNA, 19 nt, Homo Sapiens
cagaggaaaaaaccaaaug

SEQ ID NO: 3230 - RNA, 22 nt, Homo Sapiens
caacagaagaauaaacaaacug

SEQ ID NO: 3231 - RNA, 19 nt, Homo Sapiens
caucaagaauaaacacaaa

SEQ ID NO: 3232 - RNA, 18 nt, Homo Sapiens
caugagagaauaacaaau

SEQ ID NO: 3233 - RNA, 28 nt, Homo Sapiens
uaacagaucuagagaauaaaaacacaug

SEQ ID NO: 3234 - RNA, 21 nt, Homo Sapiens
uaacaaucagagaaaaauacc

SEQ ID NO: 3235 - RNA, 24 nt, Homo Sapiens
uaaauaugaugaauaaaccaaaug

SEQ ID NO: 3236 - RNA, 25 nt, Homo Sapiens
uaaauucugaaguaaaaaccaaaug

SEQ ID NO: 3237 - RNA, 25 nt, Homo Sapiens
uaaaauaagaauuaacaaaccaaau

SEQ ID NO: 3238 - RNA, 20 nt, Homo Sapiens
uaaauaaagacauaaaccaa

SEQ ID NO: 3239 - RNA, 25 nt, Homo Sapiens
uaacauuagaaaaauuaaaccaaau

SEQ ID NO: 3240 - RNA, 24 nt, Homo Sapiens
uaacucaggaauggaaaaccaaau

SEQ ID NO: 3241 - RNA, 25 nt, Homo Sapiens
uaucaucugagaauaaauguaaaug

SEQ ID NO: 3242 - RNA, 18 nt, Homo Sapiens
uaacucaccaauaaacca

SEQ ID NO: 3243 - RNA, 21 nt, Homo Sapiens
uaacaucagcggcaaaaccaa

SEQ ID NO: 3244 - RNA, 21 nt, Homo Sapiens
uaacaauaaaaauaaaccaaa

SEQ ID NO: 3245 - RNA, 21 nt, Homo Sapiens
uaaauucagagaaugccaaau

SEQ ID NO: 3246 - RNA, 24 nt, Homo Sapiens
ucagagaauuucaaacaccaaaug

SEQ ID NO: 3247 - RNA, 64 nt, Homo Sapiens
gacuuugcuuccgguacaaacaggccaccugagcacuggugguggccugcuccggcugcuuguc

SEQ ID NO: 3248 - RNA, 24 nt, Homo Sapiens
acuuugcuuccgguacaaacaggc

SEQ ID NO: 3249 - RNA, 19 nt, Homo Sapiens
acuauugauugguacaaac

SEQ ID NO: 3250 - RNA, 21 nt, Homo Sapiens
acuuugcuuuacuaguucaaa

SEQ ID NO: 3251 - RNA, 22 nt, Homo Sapiens
acuuugcuuucuugaaguacaa

SEQ ID NO: 3252 - RNA, 23 nt, Homo Sapiens
acuuugcuuccugcuaaaaaggc

SEQ ID NO: 3253 - RNA, 25 nt, Homo Sapiens
acuuugcuuccauucacaggacagg

SEQ ID NO: 3254 - RNA, 19 nt, Homo Sapiens
acuuugcuucugauugaaa

SEQ ID NO: 3255 - RNA, 20 nt, Homo Sapiens
acuuugcuucuuucagacag

SEQ ID NO: 3256 - RNA, 21 nt, Homo Sapiens
acuuuguuucaauacaaacag

SEQ ID NO: 3257 - RNA, 20 nt, Homo Sapiens
acuuuuguuccacaaacagg

SEQ ID NO: 3258 - RNA, 19 nt, Homo Sapiens
cuuugcuucaggaccacca

SEQ ID NO: 3259 - RNA, 21 nt, Homo Sapiens
cuugccauucaguacaaacag

SEQ ID NO: 3260 - RNA, 19 nt, Homo Sapiens
ugcuuccggugaaaacugg

SEQ ID NO: 3261 - RNA, 20 nt, Homo Sapiens
uuugcauuuuaguacaaaca

SEQ ID NO: 3262 - RNA, 21 nt, Homo Sapiens
uuuuuuuccagguacaaacag

SEQ ID NO: 3263 - RNA, 19 nt, Homo Sapiens
uuuucucaggacaaacagg

SEQ ID NO: 3264 - RNA, 20 nt, Homo Sapiens
uuuucuggaggacaaacagg

SEQ ID NO: 3265 - RNA, 21 nt, Homo Sapiens
uuuguucuuauucaaacaggc

SEQ ID NO: 3266 - RNA, 67 nt, Homo Sapiens
gagagcauuagacccaagaccauuguggagaagauugacuugacaguguguccagcauaaugcucuc

SEQ ID NO: 3267 - RNA, 24 nt, Homo Sapiens
caguguguccagcauaaugcucuc

SEQ ID NO: 3268 - RNA, 20 nt, Homo Sapiens
aguguguccuccacagcucu

SEQ ID NO: 3269 - RNA, 24 nt, Homo Sapiens
cagugauacuguccagcagcaugc

SEQ ID NO: 3270 - RNA, 20 nt, Homo Sapiens
cacuguggaauccagcauaa

SEQ ID NO: 3271 - RNA, 18 nt, Homo Sapiens
cagugugucaccaaaggc

SEQ ID NO: 3272 - RNA, 21 nt, Homo Sapiens
cacuauguccagcacugugcu

SEQ ID NO: 3273 - RNA, 20 nt, Homo Sapiens
cagugugucagaagauguuc

SEQ ID NO: 3274 - RNA, 21 nt, Homo Sapiens
cagugugucccucccaaucuc

SEQ ID NO: 3275 - RNA, 22 nt, Homo Sapiens
cacuuuguacccaaaugcucuc

SEQ ID NO: 3276 - RNA, 22 nt, Homo Sapiens
guguccagcacaugucacucuc

SEQ ID NO: 3277 - RNA, 19 nt, Homo Sapiens
ugaccaggaauaaugcucu

SEQ ID NO: 3278 - RNA, 20 nt, Homo Sapiens
ugucaaacaugaaugcucuc

SEQ ID NO: 3279 - RNA, 62 nt, Homo Sapiens
gagagcgcuauaggaucccuuuuacaagggcacuaaucccacucaugaucuaauuagcucuc

SEQ ID NO: 3280 - RNA, 24 nt, Homo Sapiens
cccacucaugaucuaauuagcucu

SEQ ID NO: 3281 - RNA, 21 nt, Homo Sapiens
acucugagguuaauuagcucu

SEQ ID NO: 3282 - RNA, 17 nt, Homo Sapiens
acacauucaauuagcuc

SEQ ID NO: 3283 - RNA, 21 nt, Homo Sapiens
ccacucaugcuauagauaccu

SEQ ID NO: 3284 - RNA, 23 nt, Homo Sapiens
cccauucacugcauuaauuagcu

SEQ ID NO: 3285 - RNA, 23 nt, Homo Sapiens
cccacucauaacuucuauuuagc

SEQ ID NO: 3286 - RNA, 18 nt, Homo Sapiens
cccaugauaaucuaauua

SEQ ID NO: 3287 - RNA, 72 nt, Homo Sapiens
gagaugaaauguuuuacuucugacugugggacuaauguguuccuacagguugcaacauaaaacggauuucuc

SEQ ID NO: 3288 - RNA, 24 nt, Homo Sapiens
ugaaauguuuuacuucugacugug

SEQ ID NO: 3289 - RNA, 26 nt, Homo Sapiens
aaauguuuuauuucuagaaaacugug

SEQ ID NO: 3290 - RNA, 20 nt, Homo Sapiens
aaaugcugaccuucugacug

SEQ ID NO: 3291 - RNA, 18 nt, Homo Sapiens
aaauguuuuucucugcug

SEQ ID NO: 3292 - RNA, 20 nt, Homo Sapiens
gaaaccuugcuuacuucuga

SEQ ID NO: 3293 - RNA, 23 nt, Homo Sapiens
gaaaucuuuaauguacuucugac

SEQ ID NO: 3294 - RNA, 23 nt, Homo Sapiens
gaaauguuuuauccuuagcugug

SEQ ID NO: 3295 - RNA, 20 nt, Homo Sapiens
ugaaauguuuguauucagac

SEQ ID NO: 3296 - RNA, 25 nt, Homo Sapiens
ugaaauguuuuaaagucuucaaacu

SEQ ID NO: 3297 - RNA, 26 nt, Homo Sapiens
ugaaauguuuuaauaguggaacugug

SEQ ID NO: 3298 - RNA, 19 nt, Homo Sapiens
ugagaucuuuuacuucaga

SEQ ID NO: 3299 - RNA, 21 nt, Homo Sapiens
ugaucuguuuuucuucugacu

SEQ ID NO: 3300 - RNA, 19 nt, Homo Sapiens
ugaaauguucuucucccug

SEQ ID NO: 3301 - RNA, 22 nt, Homo Sapiens
ugaaauguuugacuucucagug

SEQ ID NO: 3302 - RNA, 21 nt, Homo Sapiens
ugaaauguuugucuuuucugu

SEQ ID NO: 3303 - RNA, 21 nt, Homo Sapiens
ugaaauguuuucuucccugug

SEQ ID NO: 3304 - RNA, 20 nt, Homo Sapiens
uguucugaaacuucugacug

SEQ ID NO: 3305 - RNA, 20 nt, Homo Sapiens
ugucuuacuucugcaaugug

SEQ ID NO: 3306 - RNA, 61 nt, Homo Sapiens
gagaugagacauuuugccuagcugaugaccacuuaguucucaagaagcaacuaucucuuuc

SEQ ID NO: 3307 - RNA, 24 nt, Homo Sapiens
ugagacauuuugccuagcugauga

SEQ ID NO: 3308 - RNA, 19 nt, Homo Sapiens
acacuuuugccuauugaug

SEQ ID NO: 3309 - RNA, 18 nt, Homo Sapiens
accuuuugccuauaauga

SEQ ID NO: 3310 - RNA, 19 nt, Homo Sapiens
agacauuuugagagcugau

SEQ ID NO: 3311 - RNA, 19 nt, Homo Sapiens
agacauuuucugcugguga

SEQ ID NO: 3312 - RNA, 19 nt, Homo Sapiens
agacauuuugcacugagga

SEQ ID NO: 3313 - RNA, 24 nt, Homo Sapiens
ugagaaucacuuuucagcugauga

SEQ ID NO: 3314 - RNA, 19 nt, Homo Sapiens
ugagacuugauugccuagc

SEQ ID NO: 3315 - RNA, 68 nt, Homo Sapiens
gagaugggauuucaccauguuggccaggccugucuugaacucuugaccucaagugauccacccaccuc

SEQ ID NO: 3316 - RNA, 24 nt, Homo Sapiens
ugggauuucaccauguuggccagg

SEQ ID NO: 3317 - RNA, 20 nt, Homo Sapiens
gaccucaggugauccaccca

SEQ ID NO: 3318 - RNA, 19 nt, Homo Sapiens
ucuugaccucacugcaucc

SEQ ID NO: 3319 - RNA, 22 nt, Homo Sapiens
uccugaccucaagugauccacc

SEQ ID NO: 3320 - RNA, 22 nt, Homo Sapiens
uccugaccucaggugauccacc

SEQ ID NO: 3321 - RNA, 22 nt, Homo Sapiens
uccugaccuccagugauccacc

SEQ ID NO: 3322 - RNA, 21 nt, Homo Sapiens
uccugaccucgugauccaccc

SEQ ID NO: 3323 - RNA, 23 nt, Homo Sapiens
uccugaccucaagugauccaccc

SEQ ID NO: 3324 - RNA, 23 nt, Homo Sapiens
uccugaccucaagugauccgccc

SEQ ID NO: 3325 - RNA, 23 nt, Homo Sapiens
uccugaccucaggugauccaccc

SEQ ID NO: 3326 - RNA, 23 nt, Homo Sapiens
uccugaccuuaagugauccaccc

SEQ ID NO: 3327 - RNA, 23 nt, Homo Sapiens
uccugaguucaagugauccuccc

SEQ ID NO: 3328 - RNA, 23 nt, Homo Sapiens
uccugaucucaagugaucugccc

SEQ ID NO: 3329 - RNA, 23 nt, Homo Sapiens
uccuggccucaggugauccaccc

SEQ ID NO: 3330 - RNA, 23 nt, Homo Sapiens
ucgugaccucaggugauccaccc

SEQ ID NO: 3331 - RNA, 21 nt, Homo Sapiens
ucuugaccuugugauccgccc

SEQ ID NO: 3332 - RNA, 24 nt, Homo Sapiens
uccugaacucaagugauccaccca

SEQ ID NO: 3333 - RNA, 24 nt, Homo Sapiens
uccugaccucaagugauccaccca

SEQ ID NO: 3334 - RNA, 24 nt, Homo Sapiens
uccugaccucaagugaucugccca

SEQ ID NO: 3335 - RNA, 24 nt, Homo Sapiens
uccugaccucaggugauccaccca

SEQ ID NO: 3336 - RNA, 24 nt, Homo Sapiens
uccuggccucaagugauccaccca

SEQ ID NO: 3337 - RNA, 24 nt, Homo Sapiens
uccugggcucaagugauuuuccca

SEQ ID NO: 3338 - RNA, 24 nt, Homo Sapiens
ucuugaccucaggugauccaccca

SEQ ID NO: 3339 - RNA, 22 nt, Homo Sapiens
ucuugaccucauggagcagcca

SEQ ID NO: 3340 - RNA, 24 nt, Homo Sapiens
ucuuggccucaagugauccuccca

SEQ ID NO: 3341 - RNA, 20 nt, Homo Sapiens
ugaccucaagugauccaccc

SEQ ID NO: 3342 - RNA, 21 nt, Homo Sapiens
ugaccccaagugauccaccca

SEQ ID NO: 3343 - RNA, 68 nt, Homo Sapiens
gagaugggguuucaccauguuggccaggcucgucucgaacuccugacuucaggugauccacccaucuc

SEQ ID NO: 3344 - RNA, 24 nt, Homo Sapiens
ugggguuucaccauguuggccagg

SEQ ID NO: 3345 - RNA, 23 nt, Homo Sapiens
ggaguuucaccacguuggucagg

SEQ ID NO: 3346 - RNA, 19 nt, Homo Sapiens
gggguuucaugcugccagg

SEQ ID NO: 3347 - RNA, 23 nt, Homo Sapiens
gguguuuuuccauguuggucagg

SEQ ID NO: 3348 - RNA, 23 nt, Homo Sapiens
ggcuuucacccccauguuggcca

SEQ ID NO: 3349 - RNA, 24 nt, Homo Sapiens
ugggguuucacuacguuggccagg

SEQ ID NO: 3350 - RNA, 71 nt, Homo Sapiens
gagcggcagcgccgcgaugccaggcgcgucccuacagcgggccugccgccugcucguggccgucugcgcuc

SEQ ID NO: 3351 - RNA, 24 nt, Homo Sapiens
ugccgccugcucguggccgucugc

SEQ ID NO: 3352 - RNA, 18 nt, Homo Sapiens
ccgccugcuugcccgccu

SEQ ID NO: 3353 - RNA, 19 nt, Homo Sapiens
ccgccugcucgccgcucug

SEQ ID NO: 3354 - RNA, 20 nt, Homo Sapiens
cgccuuuucggggccgucug

SEQ ID NO: 3355 - RNA, 20 nt, Homo Sapiens
cgccugcucggagacguugc

SEQ ID NO: 3356 - RNA, 20 nt, Homo Sapiens
cuucuccugccgccgucugc

SEQ ID NO: 3357 - RNA, 20 nt, Homo Sapiens
gccgcacugccgccgucugc

SEQ ID NO: 3358 - RNA, 19 nt, Homo Sapiens
gccgccugcgcucggggcc

SEQ ID NO: 3359 - RNA, 25 nt, Homo Sapiens
gccgccugccugcugcccgcucugc

SEQ ID NO: 3360 - RNA, 21 nt, Homo Sapiens
gccgccugccuccuccucugc

SEQ ID NO: 3361 - RNA, 20 nt, Homo Sapiens
gcggccugcucgggcggccg

SEQ ID NO: 3362 - RNA, 24 nt, Homo Sapiens
gcccccugcucgucugcccgcugc

SEQ ID NO: 3363 - RNA, 20 nt, Homo Sapiens
gccgacgccucguggcccuc

SEQ ID NO: 3364 - RNA, 20 nt, Homo Sapiens
gccgccugcgagccagucug

SEQ ID NO: 3365 - RNA, 20 nt, Homo Sapiens
gccgccugcgccgccgccug

SEQ ID NO: 3366 - RNA, 22 nt, Homo Sapiens
gccgccugccugugggguccgc

SEQ ID NO: 3367 - RNA, 21 nt, Homo Sapiens
gccgccugcucuucgcccugc

SEQ ID NO: 3368 - RNA, 19 nt, Homo Sapiens
gcguccccggggccgucug

SEQ ID NO: 3369 - RNA, 20 nt, Homo Sapiens
gccugcucguguugguaugc

SEQ ID NO: 3370 - RNA, 26 nt, Homo Sapiens
ugcgcgccugcuccgggcgccccugc

SEQ ID NO: 3371 - RNA, 19 nt, Homo Sapiens
ugccgccugccccaggugg

SEQ ID NO: 3372 - RNA, 22 nt, Homo Sapiens
ugccgccugcccagccgcccuc

SEQ ID NO: 3373 - RNA, 21 nt, Homo Sapiens
ugccucugcccuuggccgucu

SEQ ID NO: 3374 - RNA, 22 nt, Homo Sapiens
uggcuccuucacuuggccgucu

SEQ ID NO: 3375 - RNA, 83 nt, Homo Sapiens
gagcgggcgugcauaugcgguggcgggugggguggaagggggagauccugcugcacuggccgccaaguaugaggggcgagcuc

SEQ ID NO: 3376 - RNA, 24 nt, Homo Sapiens
uaugcgguggcgggugggguggaa

SEQ ID NO: 3377 - RNA, 26 nt, Homo Sapiens
augcagguggaugccggguggggagg

SEQ ID NO: 3378 - RNA, 25 nt, Homo Sapiens
augcggggagggguggguggggugg

SEQ ID NO: 3379 - RNA, 21 nt, Homo Sapiens
auggguggcgggguggggcgg

SEQ ID NO: 3380 - RNA, 24 nt, Homo Sapiens
augcgguggugaggcuggggcugg

SEQ ID NO: 3381 - RNA, 19 nt, Homo Sapiens
cgguggcggcgugggcugg

SEQ ID NO: 3382 - RNA, 20 nt, Homo Sapiens
cgguggcggggggaagggug

SEQ ID NO: 3383 - RNA, 19 nt, Homo Sapiens
gcgguggcgcgggccgggu

SEQ ID NO: 3384 - RNA, 22 nt, Homo Sapiens
gcgguggcggcgaggaggggaa

SEQ ID NO: 3385 - RNA, 20 nt, Homo Sapiens
gcgggggugggguggggugg

SEQ ID NO: 3386 - RNA, 19 nt, Homo Sapiens
gcgguggcgguggcggugg

SEQ ID NO: 3387 - RNA, 19 nt, Homo Sapiens
gcgggggcggguggggcgg

SEQ ID NO: 3388 - RNA, 19 nt, Homo Sapiens
gcgguggcgaggggagugg

SEQ ID NO: 3389 - RNA, 19 nt, Homo Sapiens
gcgguggcggcggcggcgg

SEQ ID NO: 3390 - RNA, 19 nt, Homo Sapiens
gguggagggaguggggugg

SEQ ID NO: 3391 - RNA, 21 nt, Homo Sapiens
gggggcgggugggcgggugga

SEQ ID NO: 3392 - RNA, 19 nt, Homo Sapiens
gguggcgggaggcgggugg

SEQ ID NO: 3393 - RNA, 22 nt, Homo Sapiens
uaugucagggguggguggggug

SEQ ID NO: 3394 - RNA, 22 nt, Homo Sapiens
uauggguuugggggguggggug

SEQ ID NO: 3395 - RNA, 23 nt, Homo Sapiens
uauacgggucaggagggguggaa

SEQ ID NO: 3396 - RNA, 22 nt, Homo Sapiens
ugcugggggcggguggggggaa

SEQ ID NO: 3397 - RNA, 21 nt, Homo Sapiens
ugcagauggcgggugggggga

SEQ ID NO: 3398 - RNA, 21 nt, Homo Sapiens
uggggugggcaaggguggggu

SEQ ID NO: 3399 - RNA, 23 nt, Homo Sapiens
ugggguggagugggguggggugg

SEQ ID NO: 3400 - RNA, 24 nt, Homo Sapiens
ugcgguggcggcggcggcgcugga

SEQ ID NO: 3401 - RNA, 20 nt, Homo Sapiens
ugagguggcgagguggggug

SEQ ID NO: 3402 - RNA, 21 nt, Homo Sapiens
ugcgguggcgggucugggcgg

SEQ ID NO: 3403 - RNA, 22 nt, Homo Sapiens
ugcgguggcggcucggcgggga

SEQ ID NO: 3404 - RNA, 17 nt, Homo Sapiens
uggggugggguggggug

SEQ ID NO: 3405 - RNA, 20 nt, Homo Sapiens
ugcgguggcggcgguggugg

SEQ ID NO: 3406 - RNA, 18 nt, Homo Sapiens
uggggugggguggggugg

SEQ ID NO: 3407 - RNA, 19 nt, Homo Sapiens
ugagguggcggggguugga

SEQ ID NO: 3408 - RNA, 21 nt, Homo Sapiens
ugcuuugggggcuggggugga

SEQ ID NO: 3409 - RNA, 62 nt, Homo Sapiens
gagcggucggugacagccucaagggcuucagcaccgcgcccauggcagagccagaccgacuc

SEQ ID NO: 3410 - RNA, 20 nt, Homo Sapiens
uggcagagccagaccgacuc

SEQ ID NO: 3411 - RNA, 21 nt, Homo Sapiens
cggugacaggcugccaagggc

SEQ ID NO: 3412 - RNA, 20 nt, Homo Sapiens
cggugacagcgacagagagc

SEQ ID NO: 3413 - RNA, 17 nt, Homo Sapiens
cggugcagcucaagggc

SEQ ID NO: 3414 - RNA, 22 nt, Homo Sapiens
gucagagacagccucgaggccu

SEQ ID NO: 3415 - RNA, 23 nt, Homo Sapiens
ucggugccucagugccucaaggg

SEQ ID NO: 3416 - RNA, 19 nt, Homo Sapiens
ugacagccuccagcaggcu

SEQ ID NO: 3417 - RNA, 18 nt, Homo Sapiens
uggcagucuaagggcuuc

SEQ ID NO: 3418 - RNA, 19 nt, Homo Sapiens
uggcagagccagccgaauc

SEQ ID NO: 3419 - RNA, 65 nt, Homo Sapiens
gagcuaacagcacgagaagccaguuggggacugcccccuccuggagcagcuccugggcugugcuc

SEQ ID NO: 3420 - RNA, 24 nt, Homo Sapiens
uaacagcacgagaagccaguuggg

SEQ ID NO: 3421 - RNA, 20 nt, Homo Sapiens
aacaccagacuagaagccag

SEQ ID NO: 3422 - RNA, 20 nt, Homo Sapiens
aacagcacgagacggguggg

SEQ ID NO: 3423 - RNA, 20 nt, Homo Sapiens
acagggccacgagaaggcag

SEQ ID NO: 3424 - RNA, 22 nt, Homo Sapiens
acagcacgaagacaaccaggug

SEQ ID NO: 3425 - RNA, 19 nt, Homo Sapiens
cagcuacaagaagccaguu

SEQ ID NO: 3426 - RNA, 22 nt, Homo Sapiens
cagccccgggagaagccauggg

SEQ ID NO: 3427 - RNA, 23 nt, Homo Sapiens
uaacgagccaaagaagccagcug

SEQ ID NO: 3428 - RNA, 26 nt, Homo Sapiens
uaacagcaccaaugaagaagccuugg

SEQ ID NO: 3429 - RNA, 19 nt, Homo Sapiens
uaacagcacuggccgccag

SEQ ID NO: 3430 - RNA, 21 nt, Homo Sapiens
uaaaggcacgagaaucacguu

SEQ ID NO: 3431 - RNA, 74 nt, Homo Sapiens
gaggaacgagauggcgguucucuggaggcugagugccguuugcggugcccuaggaggccgagcucuguugcuuc

SEQ ID NO: 3432 - RNA, 24 nt, Homo Sapiens
uggcgguucucuggaggcugagug

SEQ ID NO: 3433 - RNA, 20 nt, Homo Sapiens
cggcuacucaggaggcugag

SEQ ID NO: 3434 - RNA, 24 nt, Homo Sapiens
gcaguucucuggaaaggcccagug

SEQ ID NO: 3435 - RNA, 19 nt, Homo Sapiens
gcggauaucugaggcugag

SEQ ID NO: 3436 - RNA, 22 nt, Homo Sapiens
ggcugguucccucuggaggcug

SEQ ID NO: 3437 - RNA, 28 nt, Homo Sapiens
ggcagguucucugucucggggcucagug

SEQ ID NO: 3438 - RNA, 21 nt, Homo Sapiens
ggcggcuccucuggagggagu

SEQ ID NO: 3439 - RNA, 19 nt, Homo Sapiens
ggggcuucucuggaggcug

SEQ ID NO: 3440 - RNA, 19 nt, Homo Sapiens
gguggcuuucuggaggcug

SEQ ID NO: 3441 - RNA, 21 nt, Homo Sapiens
ggcggcuuuggaggcugcgug

SEQ ID NO: 3442 - RNA, 18 nt, Homo Sapiens
gguucucugaggccuagu

SEQ ID NO: 3443 - RNA, 19 nt, Homo Sapiens
uggcggaucccucuggagg

SEQ ID NO: 3444 - RNA, 28 nt, Homo Sapiens
uggcugugcucccagugcaggcugagug

SEQ ID NO: 3445 - RNA, 19 nt, Homo Sapiens
uggguuucucuggaggaug

SEQ ID NO: 3446 - RNA, 20 nt, Homo Sapiens
uggggugcccaggaggcuga

SEQ ID NO: 3447 - RNA, 20 nt, Homo Sapiens
uggcuccuuuggaggcugag

SEQ ID NO: 3448 - RNA, 21 nt, Homo Sapiens
ugggggugccuggaggcugag

SEQ ID NO: 3449 - RNA, 65 nt, Homo Sapiens
gaggaugaaagaggaccugggagcggcaacuuuguucugguuuguuguuuucucuucccuaccuc

SEQ ID NO: 3450 - RNA, 24 nt, Homo Sapiens
ugaaagaggaccugggagcggcaa

SEQ ID NO: 3451 - RNA, 23 nt, Homo Sapiens
aaaggggccgccugggagcagca

SEQ ID NO: 3452 - RNA, 19 nt, Homo Sapiens
aaagaggaccauggagggc

SEQ ID NO: 3453 - RNA, 19 nt, Homo Sapiens
agacgggccugggagcggc

SEQ ID NO: 3454 - RNA, 26 nt, Homo Sapiens
gaaagaggauucugagaaagaggcaa

SEQ ID NO: 3455 - RNA, 22 nt, Homo Sapiens
gaaagaggaacuguuggagugg

SEQ ID NO: 3456 - RNA, 24 nt, Homo Sapiens
gaaaugggaccugggcacagaggc

SEQ ID NO: 3457 - RNA, 18 nt, Homo Sapiens
gaaagaaggugggagcgg

SEQ ID NO: 3458 - RNA, 20 nt, Homo Sapiens
gaaagaggagaugguagagg

SEQ ID NO: 3459 - RNA, 22 nt, Homo Sapiens
gaaagaggacaagagaaggcaa

SEQ ID NO: 3460 - RNA, 23 nt, Homo Sapiens
ugaaugaaggaccuggggagggg

SEQ ID NO: 3461 - RNA, 25 nt, Homo Sapiens
ugagacagugaccugggagaggaaa

SEQ ID NO: 3462 - RNA, 18 nt, Homo Sapiens
ugacaaugaccugggagc

SEQ ID NO: 3463 - RNA, 19 nt, Homo Sapiens
ugagaaaggaccuggggcg

SEQ ID NO: 3464 - RNA, 21 nt, Homo Sapiens
ugaaagaggcccuugcaccgg

SEQ ID NO: 3465 - RNA, 88 nt, Homo Sapiens
gaggauuuuauuucaagauaaaacauaacuucuacccauacuauugauuccaaagguuagaaaaaguguuuuuccucaucuuauccuu

SEQ ID NO: 3466 - RNA, 24 nt, Homo Sapiens
uucaagauaaaacauaacuucuac

SEQ ID NO: 3467 - RNA, 18 nt, Homo Sapiens
ucaaauaaacauaaccuc

SEQ ID NO: 3468 - RNA, 24 nt, Homo Sapiens
uucaagauaaaguucuaaguucua

SEQ ID NO: 3469 - RNA, 68 nt, Homo Sapiens
gaggcgggcggaucaccggaggucgggaguuugagaccagccugaccaacauggagaaaccccaucuc

SEQ ID NO: 3470 - RNA, 24 nt, Homo Sapiens
ugaccaacauggagaaaccccauc

SEQ ID NO: 3471 - RNA, 19 nt, Homo Sapiens
accaacaugugaaaagccc

SEQ ID NO: 3472 - RNA, 23 nt, Homo Sapiens
gaccaacauggugaaaccccguc

SEQ ID NO: 3473 - RNA, 20 nt, Homo Sapiens
ugaccaacauggagaaaccc

SEQ ID NO: 3474 - RNA, 20 nt, Homo Sapiens
ugaccaacauggugaaaccc

SEQ ID NO: 3475 - RNA, 21 nt, Homo Sapiens
uggccaacauggugaaacccc

SEQ ID NO: 3476 - RNA, 24 nt, Homo Sapiens
ugaccaacaaggagaaaccccguc

SEQ ID NO: 3477 - RNA, 24 nt, Homo Sapiens
ugaccaacauggagaaaccccguc

SEQ ID NO: 3478 - RNA, 24 nt, Homo Sapiens
ugaccaacauggggaaaccccguc

SEQ ID NO: 3479 - RNA, 24 nt, Homo Sapiens
ugaccaacauggugaaaccccauc

SEQ ID NO: 3480 - RNA, 24 nt, Homo Sapiens
ugaccaacauggugaaaccccguc

SEQ ID NO: 3481 - RNA, 24 nt, Homo Sapiens
ugaccaauauggugaaaccccauc

SEQ ID NO: 3482 - RNA, 24 nt, Homo Sapiens
uggccaacacggugaaaccccauc

SEQ ID NO: 3483 - RNA, 24 nt, Homo Sapiens
uggccaacauagugaaaccccauc

SEQ ID NO: 3484 - RNA, 24 nt, Homo Sapiens
uggccaacaugaugaaaccccauc

SEQ ID NO: 3485 - RNA, 24 nt, Homo Sapiens
uggccaacauggagaaaccccauc

SEQ ID NO: 3486 - RNA, 24 nt, Homo Sapiens
uggccaacauggggaaaccccauc

SEQ ID NO: 3487 - RNA, 23 nt, Homo Sapiens
uggccaacauggugaaacccauc

SEQ ID NO: 3488 - RNA, 24 nt, Homo Sapiens
uggccaacauggugaaacccaauc

SEQ ID NO: 3489 - RNA, 24 nt, Homo Sapiens
uggccaacauggugaaaccccauc

SEQ ID NO: 3490 - RNA, 24 nt, Homo Sapiens
uggccaacauggugaaaccccguc

SEQ ID NO: 3491 - RNA, 24 nt, Homo Sapiens
uggccaacauggugaaacuccauc

SEQ ID NO: 3492 - RNA, 24 nt, Homo Sapiens
uggccaacauggugaaaucccauc

SEQ ID NO: 3493 - RNA, 24 nt, Homo Sapiens
uggccaacauggugaaaucccguc

SEQ ID NO: 3494 - RNA, 71 nt, Homo Sapiens
gagggauagcauucgaaggacucggggauaucuaacagcaauaccugaucacuacuucgcacuaguuucuc

SEQ ID NO: 3495 - RNA, 23 nt, Homo Sapiens
ucacuacuucgcacuaguuucuc

SEQ ID NO: 3496 - RNA, 18 nt, Homo Sapiens
agggacaggcgaaggacu

SEQ ID NO: 3497 - RNA, 24 nt, Homo Sapiens
agcgagagcagucccaggacucgg

SEQ ID NO: 3498 - RNA, 19 nt, Homo Sapiens
cacauacccugcacuaguu

SEQ ID NO: 3499 - RNA, 18 nt, Homo Sapiens
cuauucaugcacuaguuu

SEQ ID NO: 3500 - RNA, 19 nt, Homo Sapiens
cuaccuucacuaguuucuc

SEQ ID NO: 3501 - RNA, 24 nt, Homo Sapiens
gggacaggcagcagaaggacucgg

SEQ ID NO: 3502 - RNA, 18 nt, Homo Sapiens
gggauagcagcucgggac

SEQ ID NO: 3503 - RNA, 22 nt, Homo Sapiens
ggaagaacauucgaaggagcuc

SEQ ID NO: 3504 - RNA, 20 nt, Homo Sapiens
ggcaugccagugaaggacuc

SEQ ID NO: 3505 - RNA, 21 nt, Homo Sapiens
ucacuacuucucuagacucuc

SEQ ID NO: 3506 - RNA, 85 nt, Homo Sapiens
gaggguguuaucuccaaugucaauaagaauugaugaauaagaauguauaucaauauggaggagauagguggagaaagacguguuu

SEQ ID NO: 3507 - RNA, 24 nt, Homo Sapiens
aucaauauggaggagauaggugga

SEQ ID NO: 3508 - RNA, 21 nt, Homo Sapiens
aaugauggaggagacaggggg

SEQ ID NO: 3509 - RNA, 19 nt, Homo Sapiens
aaaaugguugagauaggug

SEQ ID NO: 3510 - RNA, 18 nt, Homo Sapiens
aauauggagagacaggug

SEQ ID NO: 3511 - RNA, 24 nt, Homo Sapiens
auaucugaggagauaucuggugga

SEQ ID NO: 3512 - RNA, 19 nt, Homo Sapiens
auauggaggcaagauaagu

SEQ ID NO: 3513 - RNA, 22 nt, Homo Sapiens
auaaauauggaguggagaguug

SEQ ID NO: 3514 - RNA, 18 nt, Homo Sapiens
aucaauauggaauaugug

SEQ ID NO: 3515 - RNA, 24 nt, Homo Sapiens
caauauggagaaagacgaggucga

SEQ ID NO: 3516 - RNA, 20 nt, Homo Sapiens
caauauggaggccaaagcug

SEQ ID NO: 3517 - RNA, 20 nt, Homo Sapiens
caauauggaaauauaggagg

SEQ ID NO: 3518 - RNA, 19 nt, Homo Sapiens
uauaggaggcauaggugga

SEQ ID NO: 3519 - RNA, 20 nt, Homo Sapiens
ucaauauggaugcagauggu

SEQ ID NO: 3520 - RNA, 19 nt, Homo Sapiens
ucaauauggaguaaaauag

SEQ ID NO: 3521 - RNA, 20 nt, Homo Sapiens
uggaggagaaguuuuggugg

SEQ ID NO: 3522 - RNA, 68 nt, Homo Sapiens
gaggugccggugggccuguguugcugcgauuuuagucugugcugggaggcagggcuccgcugcgccuc

SEQ ID NO: 3523 - RNA, 24 nt, Homo Sapiens
ugggaggcagggcuccgcugcgcc

SEQ ID NO: 3524 - RNA, 19 nt, Homo Sapiens
aggcagggcccugcugagc

SEQ ID NO: 3525 - RNA, 22 nt, Homo Sapiens
gaggcagggaggcucccgcugc

SEQ ID NO: 3526 - RNA, 20 nt, Homo Sapiens
ggaggcaggggcuuggcagc

SEQ ID NO: 3527 - RNA, 22 nt, Homo Sapiens
ggagcagggcuccuuugcagcc

SEQ ID NO: 3528 - RNA, 22 nt, Homo Sapiens
ggaggcaggguuccacucugcc

SEQ ID NO: 3529 - RNA, 21 nt, Homo Sapiens
ggcagggcugaccccuucgcc

SEQ ID NO: 3530 - RNA, 24 nt, Homo Sapiens
gggaggcagagguugcggugagcc

SEQ ID NO: 3531 - RNA, 25 nt, Homo Sapiens
ggcaggcagagcaguguccgcugcg

SEQ ID NO: 3532 - RNA, 25 nt, Homo Sapiens
ggggggcagggcugggcagcugggc

SEQ ID NO: 3533 - RNA, 22 nt, Homo Sapiens
gggaggcaggggugacggcugc

SEQ ID NO: 3534 - RNA, 24 nt, Homo Sapiens
gggaggcaggcucggggcugggcc

SEQ ID NO: 3535 - RNA, 23 nt, Homo Sapiens
gggaagaagggccccgcugcgcc

SEQ ID NO: 3536 - RNA, 21 nt, Homo Sapiens
ugggaggcauggucucccugc

SEQ ID NO: 3537 - RNA, 25 nt, Homo Sapiens
ugggaggcagagguuaccgugagcc

SEQ ID NO: 3538 - RNA, 24 nt, Homo Sapiens
ugggaggcagagguugcacugagc

SEQ ID NO: 3539 - RNA, 25 nt, Homo Sapiens
ugggaggcagagguugcacugagcc

SEQ ID NO: 3540 - RNA, 25 nt, Homo Sapiens
uguggggcagggcugcugcugcccc

SEQ ID NO: 3541 - RNA, 19 nt, Homo Sapiens
ugggaggcaguguuccacu

SEQ ID NO: 3542 - RNA, 23 nt, Homo Sapiens
ugggaggcacggcccccuccucc

SEQ ID NO: 3543 - RNA, 67 nt, Homo Sapiens
gaggugggaggucacccgaggucaggugucugugaccaggccggccaacauggugaaaccccgucuc

SEQ ID NO: 3544 - RNA, 24 nt, Homo Sapiens
ugggaggucacccgaggucaggug

SEQ ID NO: 3545 - RNA, 21 nt, Homo Sapiens
ggaggaucaccugaggucagg

SEQ ID NO: 3546 - RNA, 19 nt, Homo Sapiens
ggcggaucacgaggucagg

SEQ ID NO: 3547 - RNA, 19 nt, Homo Sapiens
gguggaucacgaggucagg

SEQ ID NO: 3548 - RNA, 21 nt, Homo Sapiens
gguggaucaccugaggucagg

SEQ ID NO: 3549 - RNA, 21 nt, Homo Sapiens
gggggugcgcccgaggucugg

SEQ ID NO: 3550 - RNA, 20 nt, Homo Sapiens
ggugaucaccugaggucagg

SEQ ID NO: 3551 - RNA, 22 nt, Homo Sapiens
gggcggaucaccugaggucagg

SEQ ID NO: 3552 - RNA, 22 nt, Homo Sapiens
ggguggaucaccugaggucagg

SEQ ID NO: 3553 - RNA, 22 nt, Homo Sapiens
ggguggaucacuugaggucagg

SEQ ID NO: 3554 - RNA, 23 nt, Homo Sapiens
gggaggucacccucgaggccggg

SEQ ID NO: 3555 - RNA, 21 nt, Homo Sapiens
ggcagaucaccugaggucagg

SEQ ID NO: 3556 - RNA, 21 nt, Homo Sapiens
ggcagaucacuugaggucagg

SEQ ID NO: 3557 - RNA, 21 nt, Homo Sapiens
gguagaucaccugaggucagg

SEQ ID NO: 3558 - RNA, 19 nt, Homo Sapiens
ucacuccgcaggucaggug

SEQ ID NO: 3559 - RNA, 23 nt, Homo Sapiens
ugggcagaucaccugaggucagg

SEQ ID NO: 3560 - RNA, 23 nt, Homo Sapiens
uggguagaucaccugaggucagg

SEQ ID NO: 3561 - RNA, 21 nt, Homo Sapiens
ugggagggugucacccgaggu

SEQ ID NO: 3562 - RNA, 21 nt, Homo Sapiens
uggguggaucacccgagguca

SEQ ID NO: 3563 - RNA, 23 nt, Homo Sapiens
ugggcggaucaccugaggucagg

SEQ ID NO: 3564 - RNA, 23 nt, Homo Sapiens
ugggcggaucaguugaggucagg

SEQ ID NO: 3565 - RNA, 23 nt, Homo Sapiens
ugggcggauuaccugaggucagg

SEQ ID NO: 3566 - RNA, 23 nt, Homo Sapiens
ugggugcaucaccugaggucagg

SEQ ID NO: 3567 - RNA, 23 nt, Homo Sapiens
uggguggaucacccgagguuagg

SEQ ID NO: 3568 - RNA, 23 nt, Homo Sapiens
uggguggaucaccugaggucagg

SEQ ID NO: 3569 - RNA, 17 nt, Homo Sapiens
ugggaaacccgagguca

SEQ ID NO: 3570 - RNA, 97 nt, Homo Sapiens
gaguccacuggugcccaguaacacccuccgugggaccaccuugggaagcaugugccgcggaguccaccacgggggguccugggucccgggagggcuc

SEQ ID NO: 3571 - RNA, 24 nt, Homo Sapiens
uaacacccuccgugggaccaccuu

SEQ ID NO: 3572 - RNA, 23 nt, Homo Sapiens
aaaacuccuccgugggaagcacc

SEQ ID NO: 3573 - RNA, 19 nt, Homo Sapiens
aacacccuccaguagggcc

SEQ ID NO: 3574 - RNA, 20 nt, Homo Sapiens
aacacccuccucugagccca

SEQ ID NO: 3575 - RNA, 20 nt, Homo Sapiens
cacccagccgugggaccccu

SEQ ID NO: 3576 - RNA, 20 nt, Homo Sapiens
cacccuccgcuggaaaaccu

SEQ ID NO: 3577 - RNA, 20 nt, Homo Sapiens
cccugccccgugggaccccu

SEQ ID NO: 3578 - RNA, 66 nt, Homo Sapiens
gagucgauaacuguuguccuacucaccggugguuucaguggcuaauuagaacugugguauugauuc

SEQ ID NO: 3579 - RNA, 24 nt, Homo Sapiens
uaacuguuguccuacucaccggug

SEQ ID NO: 3580 - RNA, 16 nt, Homo Sapiens
cuguuguccucacagg

SEQ ID NO: 3581 - RNA, 17 nt, Homo Sapiens
cuguuguccacuacugg

SEQ ID NO: 3582 - RNA, 24 nt, Homo Sapiens
uaacuguugcaguucuaugcucac

SEQ ID NO: 3583 - RNA, 22 nt, Homo Sapiens
uaccuguuucuuuucaccggug

SEQ ID NO: 3584 - RNA, 66 nt, Homo Sapiens
gagugccucgcucgguaacugcuugguccugaacauucucucguuucaggaacugaugagguucuc

SEQ ID NO: 3585 - RNA, 20 nt, Homo Sapiens
caggaacugaugagguucuc

SEQ ID NO: 3586 - RNA, 20 nt, Homo Sapiens
aggcagcugaugagguuguc

SEQ ID NO: 3587 - RNA, 20 nt, Homo Sapiens
aggggcugaucugagguucu

SEQ ID NO: 3588 - RNA, 19 nt, Homo Sapiens
cagugaacugauguuguuc

SEQ ID NO: 3589 - RNA, 25 nt, Homo Sapiens
caggugcaccugaucugagguucuc

SEQ ID NO: 3590 - RNA, 23 nt, Homo Sapiens
cagguacaucaucugagguucuc

SEQ ID NO: 3591 - RNA, 21 nt, Homo Sapiens
ggaacuaaagauugagguucu

SEQ ID NO: 3592 - RNA, 19 nt, Homo Sapiens
ggcacugaugaggcuacuc

SEQ ID NO: 3593 - RNA, 85 nt, Homo Sapiens
gaguugcgagggaggcugcgggggcgggcggacguauguugagacccuaugcagccuccugcucucccgagggcuccugcggcuc

SEQ ID NO: 3594 - RNA, 24 nt, Homo Sapiens
gcagccuccugcucucccgagggc

SEQ ID NO: 3595 - RNA, 22 nt, Homo Sapiens
agccuccugcacccucgggcgc

SEQ ID NO: 3596 - RNA, 20 nt, Homo Sapiens
cagccacuccugcucugccg

SEQ ID NO: 3597 - RNA, 22 nt, Homo Sapiens
cagccuuuccaguucucccgag

SEQ ID NO: 3598 - RNA, 22 nt, Homo Sapiens
cagcuccaggaucucccgaggg

SEQ ID NO: 3599 - RNA, 21 nt, Homo Sapiens
caggcccugcucucccgcagg

SEQ ID NO: 3600 - RNA, 16 nt, Homo Sapiens
cagccuccugccccga

SEQ ID NO: 3601 - RNA, 20 nt, Homo Sapiens
cagcaucugcucuccagggc

SEQ ID NO: 3602 - RNA, 21 nt, Homo Sapiens
cagccuccugaucccuggggc

SEQ ID NO: 3603 - RNA, 21 nt, Homo Sapiens
cagucuccugcucuggagggc

SEQ ID NO: 3604 - RNA, 25 nt, Homo Sapiens
gcaggccggccggcuccccgagggc

SEQ ID NO: 3605 - RNA, 20 nt, Homo Sapiens
gcagcuccucacugcucucc

SEQ ID NO: 3606 - RNA, 25 nt, Homo Sapiens
gcagcccgcgucccucucucccgag

SEQ ID NO: 3607 - RNA, 19 nt, Homo Sapiens
gccgccuccugccgucucc

SEQ ID NO: 3608 - RNA, 22 nt, Homo Sapiens
gcagccuccugcacugggcccg

SEQ ID NO: 3609 - RNA, 22 nt, Homo Sapiens
gcagccuccgcucccgccgcgg

SEQ ID NO: 3610 - RNA, 23 nt, Homo Sapiens
gcaccugcugcucuccaacgagg

SEQ ID NO: 3611 - RNA, 19 nt, Homo Sapiens
gcagccucccguucccccg

SEQ ID NO: 3612 - RNA, 18 nt, Homo Sapiens
gcagccuccugccuuccg

SEQ ID NO: 3613 - RNA, 19 nt, Homo Sapiens
gcagccuccgccuccugag

SEQ ID NO: 3614 - RNA, 22 nt, Homo Sapiens
gccgcggccugcgcucccgagg

SEQ ID NO: 3615 - RNA, 22 nt, Homo Sapiens
gccuccugcuccgaccccgagg

SEQ ID NO: 3616 - RNA, 22 nt, Homo Sapiens
gccgcuugcucuccccagcggc

SEQ ID NO: 3617 - RNA, 17 nt, Homo Sapiens
gccuccugccucccagg

SEQ ID NO: 3618 - RNA, 18 nt, Homo Sapiens
gccuccugccuccccagg

SEQ ID NO: 3619 - RNA, 18 nt, Homo Sapiens
gccuccugcucggccagg

SEQ ID NO: 3620 - RNA, 20 nt, Homo Sapiens
gccuccugcuccccaaaggg

SEQ ID NO: 3621 - RNA, 20 nt, Homo Sapiens
gccuccugccgcccgccggc

SEQ ID NO: 3622 - RNA, 65 nt, Homo Sapiens
gauaaggaccuguuuggggcagcagggagcaaaaucuccuuuaacaaccaagcaguuccucauuc

SEQ ID NO: 3623 - RNA, 24 nt, Homo Sapiens
uaaggaccuguuuggggcagcagg

SEQ ID NO: 3624 - RNA, 25 nt, Homo Sapiens
aggagcccggcuggagggcagcagg

SEQ ID NO: 3625 - RNA, 23 nt, Homo Sapiens
aggaugcugcuucuggcagcagg

SEQ ID NO: 3626 - RNA, 22 nt, Homo Sapiens
agggccugcccguggcagcagg

SEQ ID NO: 3627 - RNA, 20 nt, Homo Sapiens
ccuuuuucugggggcagcag

SEQ ID NO: 3628 - RNA, 19 nt, Homo Sapiens
ccuguuuggggacaggcag

SEQ ID NO: 3629 - RNA, 20 nt, Homo Sapiens
cuguuuauggaggcagcagg

SEQ ID NO: 3630 - RNA, 20 nt, Homo Sapiens
gacucuggucagggcagcag

SEQ ID NO: 3631 - RNA, 21 nt, Homo Sapiens
gacgcuguugggggcagcagg

SEQ ID NO: 3632 - RNA, 21 nt, Homo Sapiens
gacucugcucagggcagcagg

SEQ ID NO: 3633 - RNA, 21 nt, Homo Sapiens
gacucuggucagggcagcagg

SEQ ID NO: 3634 - RNA, 23 nt, Homo Sapiens
gaccuauguucuggggcagcagg

SEQ ID NO: 3635 - RNA, 19 nt, Homo Sapiens
gaccuguuuuggggugcag

SEQ ID NO: 3636 - RNA, 21 nt, Homo Sapiens
gggccuguaguggggcagcag

SEQ ID NO: 3637 - RNA, 24 nt, Homo Sapiens
uaauggacuguguucuggggcagc

SEQ ID NO: 3638 - RNA, 20 nt, Homo Sapiens
uaaggaccucuauugagcag

SEQ ID NO: 3639 - RNA, 17 nt, Homo Sapiens
uaagguccuuggggcag

SEQ ID NO: 3640 - RNA, 18 nt, Homo Sapiens
uaagaccuguuuggcagc

SEQ ID NO: 3641 - RNA, 23 nt, Homo Sapiens
uaagccucuauuuugggcagcag

SEQ ID NO: 3642 - RNA, 19 nt, Homo Sapiens
uguuugggcaggcagcagg

SEQ ID NO: 3643 - RNA, 66 nt, Homo Sapiens
gauaaggaccuguuuggggcagcagggagcaaaaucuccuuuaacaaccaagcaguuuccucauuc

SEQ ID NO: 3644 - RNA, 66 nt, Homo Sapiens; identical to SEQ ID NO: 3643

SEQ ID NO: 3645 - RNA, 66 nt, Homo Sapiens; identical to SEQ ID NO: 3643

SEQ ID NO: 3646 - RNA, 66 nt, Homo Sapiens; identical to SEQ ID NO: 3643

SEQ ID NO: 3647 - RNA, 66 nt, Homo Sapiens; identical to SEQ ID NO: 3643

SEQ ID NO: 3648 - RNA, 66 nt, Homo Sapiens; identical to SEQ ID NO: 3643

SEQ ID NO: 3649 - RNA, 66 nt, Homo Sapiens; identical to SEQ ID NO: 3643

SEQ ID NO: 3650 - RNA, 66 nt, Homo Sapiens; identical to SEQ ID NO: 3643

SEQ ID NO: 3651 - RNA, 66 nt, Homo Sapiens; identical to SEQ ID NO: 3643

SEQ ID NO: 3652 - RNA, 66 nt, Homo Sapiens; identical to SEQ ID NO: 3643

SEQ ID NO: 3653 - RNA, 66 nt, Homo Sapiens; identical to SEQ ID NO: 3643

SEQ ID NO: 3654 - RNA, 66 nt, Homo Sapiens; identical to SEQ ID NO: 3643

SEQ ID NO: 3655 - RNA, 66 nt, Homo Sapiens; identical to SEQ ID NO: 3643

SEQ ID NO: 3656 - RNA, 66 nt, Homo Sapiens; identical to SEQ ID NO: 3643

SEQ ID NO: 3657 - RNA, 66 nt, Homo Sapiens; identical to SEQ ID NO: 3643

SEQ ID NO: 3658 - RNA, 66 nt, Homo Sapiens; identical to SEQ ID NO: 3643

SEQ ID NO: 3659 - RNA, 66 nt, Homo Sapiens; identical to SEQ ID NO: 3643

SEQ ID NO: 3660 - RNA, 65 nt, Homo Sapiens
gauaaggaccuguuuggugcagcagggagcaaaaucuccuuuaacaaccaagcaguuccucauuc

SEQ ID NO: 3661 - RNA, 24 nt, Homo Sapiens
uaaggaccuguuuggugcagcagg

SEQ ID NO: 3662 - RNA, 28 nt, Homo Sapiens
aaggauccuaaguccuuagugcagcagg

SEQ ID NO: 3663 - RNA, 24 nt, Homo Sapiens
aaggagccguugcgcugcagcagg

SEQ ID NO: 3664 - RNA, 16 nt, Homo Sapiens
aagguguuugguguag

SEQ ID NO: 3665 - RNA, 19 nt, Homo Sapiens
aaggggcugcggugcagca

SEQ ID NO: 3666 - RNA, 22 nt, Homo Sapiens
aggcacuugguuuggugcauca

SEQ ID NO: 3667 - RNA, 21 nt, Homo Sapiens
agcaccuguuuguauacagca

SEQ ID NO: 3668 - RNA, 19 nt, Homo Sapiens
cuguguagacugcagcagg

SEQ ID NO: 3669 - RNA, 17 nt, Homo Sapiens
gagcuguugugcagcag

SEQ ID NO: 3670 - RNA, 21 nt, Homo Sapiens
uaaggaccuguagcugugcag

SEQ ID NO: 3671 - RNA, 23 nt, Homo Sapiens
uaauggccugaugaggugcagca

SEQ ID NO: 3672 - RNA, 16 nt, Homo Sapiens
uaaggguuuggugcag

SEQ ID NO: 3673 - RNA, 20 nt, Homo Sapiens
uaugaaccuguuuguuucag

SEQ ID NO: 3674 - RNA, 18 nt, Homo Sapiens
uaagaccuguuuggcagc

SEQ ID NO: 3675 - RNA, 66 nt, Homo Sapiens
gauacaagacaggcaagaacaagugguucuuccagaaacugcgguuuuagaugcuuuguuuugauc

SEQ ID NO: 3676 - RNA, 24 nt, Homo Sapiens
uacaagacaggcaagaacaagugg

SEQ ID NO: 3677 - RNA, 20 nt, Homo Sapiens
aagcaggcaagaaccagagg

SEQ ID NO: 3678 - RNA, 24 nt, Homo Sapiens
acaagacagacugaaccaaagugg

SEQ ID NO: 3679 - RNA, 17 nt, Homo Sapiens
acaagaccaagaacaag

SEQ ID NO: 3680 - RNA, 17 nt, Homo Sapiens
acaagacagggaacaag

SEQ ID NO: 3681 - RNA, 21 nt, Homo Sapiens
acaugauccgcaagaacaagu

SEQ ID NO: 3682 - RNA, 22 nt, Homo Sapiens
acaggaaaggcaagaaaacugg

SEQ ID NO: 3683 - RNA, 20 nt, Homo Sapiens
agacagucgugaagaacaag

SEQ ID NO: 3684 - RNA, 25 nt, Homo Sapiens
caagccgcggcaagaacgcaagggg

SEQ ID NO: 3685 - RNA, 22 nt, Homo Sapiens
caaacaggaaccaagaacaagu

SEQ ID NO: 3686 - RNA, 20 nt, Homo Sapiens
caagacaggcagggaaaaag

SEQ ID NO: 3687 - RNA, 22 nt, Homo Sapiens
caggucaggcaauagaacaagu

SEQ ID NO: 3688 - RNA, 26 nt, Homo Sapiens
caaaacaggcaagucaagaaaagugg

SEQ ID NO: 3689 - RNA, 21 nt, Homo Sapiens
caagacaggaaacaaaacagu

SEQ ID NO: 3690 - RNA, 22 nt, Homo Sapiens
caggcaagauagacagcagugg

SEQ ID NO: 3691 - RNA, 19 nt, Homo Sapiens
uacaaguuagaggcaagaa

SEQ ID NO: 3692 - RNA, 21 nt, Homo Sapiens
uacaagacaaaaguaagauca

SEQ ID NO: 3693 - RNA, 26 nt, Homo Sapiens
uaaaagaccauguucaagaacaacug

SEQ ID NO: 3694 - RNA, 20 nt, Homo Sapiens
uacaagacaagaaaggaaag

SEQ ID NO: 3695 - RNA, 18 nt, Homo Sapiens
uacaagacaaagcaagug

SEQ ID NO: 3696 - RNA, 63 nt, Homo Sapiens
gauaccagccucccacuguggugccugguggagaacuggccaagguacaaggaaggcuguguu

SEQ ID NO: 3697 - RNA, 24 nt, Homo Sapiens
uaccagccucccacuguggugccu

SEQ ID NO: 3698 - RNA, 23 nt, Homo Sapiens
accaccucucccacugcccugcc

SEQ ID NO: 3699 - RNA, 21 nt, Homo Sapiens
accagccucccaucagugcug

SEQ ID NO: 3700 - RNA, 22 nt, Homo Sapiens
accagccucccagggcugggcc

SEQ ID NO: 3701 - RNA, 18 nt, Homo Sapiens
accaggcccacuguggug

SEQ ID NO: 3702 - RNA, 23 nt, Homo Sapiens
ccagcacuuacacugugguaccu

SEQ ID NO: 3703 - RNA, 24 nt, Homo Sapiens
ccagccuccucacuggaugaugcc

SEQ ID NO: 3704 - RNA, 22 nt, Homo Sapiens
ccagccuccuugcugugcugcc

SEQ ID NO: 3705 - RNA, 21 nt, Homo Sapiens
ccagccuccagaacuguggug

SEQ ID NO: 3706 - RNA, 19 nt, Homo Sapiens
ccagccucggcuguggugc

SEQ ID NO: 3707 - RNA, 20 nt, Homo Sapiens
ccagccucccaugugagccu

SEQ ID NO: 3708 - RNA, 24 nt, Homo Sapiens
uaccagccuggcacugagcaugcc

SEQ ID NO: 3709 - RNA, 69 nt, Homo Sapiens
gaucacauagaaucuagggaagaaaugagaaauucugggauuuuuuuuuuuaacagaaguguugugauc

SEQ ID NO: 3710 - RNA, 24 nt, Homo Sapiens
uagaaucuagggaagaaaugagaa

SEQ ID NO: 3711 - RNA, 21 nt, Homo Sapiens
aauuuaagaagaaaaugagaa

SEQ ID NO: 3712 - RNA, 17 nt, Homo Sapiens
aaucuaggggaaaggag

SEQ ID NO: 3713 - RNA, 24 nt, Homo Sapiens
agaaacuucagccaggaaaugaga

SEQ ID NO: 3714 - RNA, 16 nt, Homo Sapiens
agaacuagaagaaaug

SEQ ID NO: 3715 - RNA, 18 nt, Homo Sapiens
aucucaaggagaaaugag

SEQ ID NO: 3716 - RNA, 21 nt, Homo Sapiens
gagucuggguccaaaugagaa

SEQ ID NO: 3717 - RNA, 109 nt, Homo Sapiens
gaucucggcguugugcaugucgggcgacugcuccaugaucuugcgccgcucgaucugcgaccacaccaugaaggcguucaugggucgcuugaugugcccacucgggguc

SEQ ID NO: 3718 - RNA, 24 nt, Homo Sapiens
ugaaggcguucaugggucgcuuga

SEQ ID NO: 3719 - RNA, 20 nt, Homo Sapiens
aaugcugucaugggucccuu

SEQ ID NO: 3720 - RNA, 19 nt, Homo Sapiens
aucauccacccucgaucug

SEQ ID NO: 3721 - RNA, 20 nt, Homo Sapiens
augaucuugggaugcuggau

SEQ ID NO: 3722 - RNA, 23 nt, Homo Sapiens
augaucuuggucucuggguacug

SEQ ID NO: 3723 - RNA, 21 nt, Homo Sapiens
cacggucuccgccgcucgcuc

SEQ ID NO: 3724 - RNA, 22 nt, Homo Sapiens
caugaucuucugcugcccaucu

SEQ ID NO: 3725 - RNA, 22 nt, Homo Sapiens
caugaucuugcuuucuccaucu

SEQ ID NO: 3726 - RNA, 23 nt, Homo Sapiens
caugaucuuuuguccucgcacug

SEQ ID NO: 3727 - RNA, 23 nt, Homo Sapiens
gaaggcagauaucaugggucacu

SEQ ID NO: 3728 - RNA, 23 nt, Homo Sapiens
gauggccuauccuuggucgcuug

SEQ ID NO: 3729 - RNA, 19 nt, Homo Sapiens
gaucuugcgcgccgcgcuc

SEQ ID NO: 3730 - RNA, 19 nt, Homo Sapiens
guucaugggaauucccuug

SEQ ID NO: 3731 - RNA, 21 nt, Homo Sapiens
ucuugcgccccguuucgaccu

SEQ ID NO: 3732 - RNA, 20 nt, Homo Sapiens
uggaggcacauucauggguc

SEQ ID NO: 3733 - RNA, 20 nt, Homo Sapiens
uguucaggcgccgcucgcuc

SEQ ID NO: 3734 - RNA, 20 nt, Homo Sapiens
ugcgccgcugccacgagcug

SEQ ID NO: 3735 - RNA, 74 nt, Homo Sapiens
gaugcucccaaacauccuauaugcauccauggaaauuuaaagauccuggaauagcgucuuccaugugggacauc

SEQ ID NO: 3736 - RNA, 24 nt, Homo Sapiens
gaauagcgucuuccaugugggaca

SEQ ID NO: 3737 - RNA, 21 nt, Homo Sapiens
aauugguucuuccaugagaga

SEQ ID NO: 3738 - RNA, 21 nt, Homo Sapiens
gaaucaucaucauccaugugg

SEQ ID NO: 3739 - RNA, 20 nt, Homo Sapiens
gaauuugagucuccaugugg

SEQ ID NO: 3740 - RNA, 21 nt, Homo Sapiens
gaauauucgugguccaugugg

SEQ ID NO: 3741 - RNA, 19 nt, Homo Sapiens
gaaggggguuuuccaugug

SEQ ID NO: 3742 - RNA, 18 nt, Homo Sapiens
gaaagguccuccaugugg

SEQ ID NO: 3743 - RNA, 19 nt, Homo Sapiens
gaaagcguuccaugugaga

SEQ ID NO: 3744 - RNA, 22 nt, Homo Sapiens
gaaaagccuccaacauguggga

SEQ ID NO: 3745 - RNA, 83 nt, Homo Sapiens
gauggaacacaugaaaucuuugguucacagacuauuuacaaucuugcauuuagaagagucucagaaaaagagagagcaccauu

SEQ ID NO: 3746 - RNA, 24 nt, Homo Sapiens
ugaaaucuuugguucacagacuau

SEQ ID NO: 3747 - RNA, 21 nt, Homo Sapiens
aaaucuuugugggcgccgacu

SEQ ID NO: 3748 - RNA, 23 nt, Homo Sapiens
aaauauuuuguagucacagacua

SEQ ID NO: 3749 - RNA, 17 nt, Homo Sapiens
aaaucauuuucacagac

SEQ ID NO: 3750 - RNA, 19 nt, Homo Sapiens
aacucuuugguucagacua

SEQ ID NO: 3751 - RNA, 22 nt, Homo Sapiens
aaaucuuugauuaaguaacuau

SEQ ID NO: 3752 - RNA, 23 nt, Homo Sapiens
aucuuccugguuuccacagacua

SEQ ID NO: 3753 - RNA, 18 nt, Homo Sapiens
aucuuuggucacaaauua

SEQ ID NO: 3754 - RNA, 25 nt, Homo Sapiens
gaauucuauuuagguuucacagacu

SEQ ID NO: 3755 - RNA, 21 nt, Homo Sapiens
gacaucuuugguugucacacu

SEQ ID NO: 3756 - RNA, 22 nt, Homo Sapiens
ugaaaucuugaucaguucccag

SEQ ID NO: 3757 - RNA, 21 nt, Homo Sapiens
ugaaaucuucuggaaaacaga

SEQ ID NO: 3758 - RNA, 17 nt, Homo Sapiens
ugaagucagguucacag

SEQ ID NO: 3759 - RNA, 19 nt, Homo Sapiens
ugaaaaguugguucacaga

SEQ ID NO: 3760 - RNA, 20 nt, Homo Sapiens
ugagagcuucuucacagacu

SEQ ID NO: 3761 - RNA, 72 nt, Homo Sapiens
gauggaauaguucagaaggaaugguaccaguuccuccuuguaccucugguagaauucggcugugaauccauc

SEQ ID NO: 3762 - RNA, 24 nt, Homo Sapiens
uggaauaguucagaaggaauggua

SEQ ID NO: 3763 - RNA, 21 nt, Homo Sapiens
aauaguucaguaauaaauagu

SEQ ID NO: 3764 - RNA, 20 nt, Homo Sapiens
aauaguucacagaaaauugu

SEQ ID NO: 3765 - RNA, 24 nt, Homo Sapiens
gauuagugauaauaaggaauggua

SEQ ID NO: 3766 - RNA, 19 nt, Homo Sapiens
gaauaguuccagaggcaau

SEQ ID NO: 3767 - RNA, 20 nt, Homo Sapiens
gaagauuccagaaggaaggg

SEQ ID NO: 3768 - RNA, 20 nt, Homo Sapiens
gaagaggacagaggaauggu

SEQ ID NO: 3769 - RNA, 20 nt, Homo Sapiens
ggaaaaguguucagaaggaa

SEQ ID NO: 3770 - RNA, 22 nt, Homo Sapiens
ggaaagcaugaaggaaugagua

SEQ ID NO: 3771 - RNA, 18 nt, Homo Sapiens
ggaaaggccagaaggaau

SEQ ID NO: 3772 - RNA, 19 nt, Homo Sapiens
gggagagauuagaaggaau

SEQ ID NO: 3773 - RNA, 21 nt, Homo Sapiens
uaguuuauaacaggaauggua

SEQ ID NO: 3774 - RNA, 19 nt, Homo Sapiens
uggacacacuucagaagga

SEQ ID NO: 3775 - RNA, 23 nt, Homo Sapiens
uggaagaugggcagaaggaaggu

SEQ ID NO: 3776 - RNA, 19 nt, Homo Sapiens
uggaauaguccaagaaaga

SEQ ID NO: 3777 - RNA, 19 nt, Homo Sapiens
ugaaacacuucagaaggaa

SEQ ID NO: 3778 - RNA, 19 nt, Homo Sapiens
uguaacaguucagaaaugg

SEQ ID NO: 3779 - RNA, 68 nt, Homo Sapiens
gauggacucuuucuuuuuaauguguccagcucuuguucuuuuucauuucuuagccugcagaguucauc

SEQ ID NO: 3780 - RNA, 24 nt, Homo Sapiens
uggacucuuucuuuuuaauguguc

SEQ ID NO: 3781 - RNA, 19 nt, Homo Sapiens
acucuuucuucaacugugu

SEQ ID NO: 3782 - RNA, 21 nt, Homo Sapiens
auuucacaaaccugcagaguu

SEQ ID NO: 3783 - RNA, 25 nt, Homo Sapiens
auuucuuaggaugcuaaguagucau

SEQ ID NO: 3784 - RNA, 22 nt, Homo Sapiens
auuucuuagcccacauauucau

SEQ ID NO: 3785 - RNA, 26 nt, Homo Sapiens
caucucucgucagccugcagcuucau

SEQ ID NO: 3786 - RNA, 19 nt, Homo Sapiens
cauuucuuaacauguauag

SEQ ID NO: 3787 - RNA, 25 nt, Homo Sapiens
cauuucuuauccagcauagauucau

SEQ ID NO: 3788 - RNA, 20 nt, Homo Sapiens
cauuucuuaaucuccacagu

SEQ ID NO: 3789 - RNA, 22 nt, Homo Sapiens
caucucuuagccuaagaguaca

SEQ ID NO: 3790 - RNA, 22 nt, Homo Sapiens
cauuucuuauacucaagaucau

SEQ ID NO: 3791 - RNA, 20 nt, Homo Sapiens
cuuuuucuuuuuuuaaugug

SEQ ID NO: 3792 - RNA, 18 nt, Homo Sapiens
cuuggaccucagaguuca

SEQ ID NO: 3793 - RNA, 22 nt, Homo Sapiens
gacucuuuccuuuuccucgugu

SEQ ID NO: 3794 - RNA, 23 nt, Homo Sapiens
gggcucuauuauuuuuaaugagu

SEQ ID NO: 3795 - RNA, 22 nt, Homo Sapiens
ggacacuuggcuuuuuaauaug

SEQ ID NO: 3796 - RNA, 21 nt, Homo Sapiens
ucuuagccuguccaaguccau

SEQ ID NO: 3797 - RNA, 22 nt, Homo Sapiens
ucuuagccuguccaaguccauc

SEQ ID NO: 3798 - RNA, 18 nt, Homo Sapiens
ucuuagccuaagaguaca

SEQ ID NO: 3799 - RNA, 20 nt, Homo Sapiens
ucuuucuuuauuacuuucuc

SEQ ID NO: 3800 - RNA, 19 nt, Homo Sapiens
ucuuucuuuucauacaugu

SEQ ID NO: 3801 - RNA, 19 nt, Homo Sapiens
ucuuucuuuauaacuuguc

SEQ ID NO: 3802 - RNA, 19 nt, Homo Sapiens
ucuuucuuucuuuuguuuc

SEQ ID NO: 3803 - RNA, 19 nt, Homo Sapiens
ucuuucuuuuuauuauuuc

SEQ ID NO: 3804 - RNA, 25 nt, Homo Sapiens
uggucucugauccuuuuuaaugagu

SEQ ID NO: 3805 - RNA, 19 nt, Homo Sapiens
ugaagucuaucuuuuuaau

SEQ ID NO: 3806 - RNA, 18 nt, Homo Sapiens
uggcuucuuucuuuuaau

SEQ ID NO: 3807 - RNA, 19 nt, Homo Sapiens
ugguuucuuccuuuuuaau

SEQ ID NO: 3808 - RNA, 22 nt, Homo Sapiens
uucuguuguuugcagaguugau

SEQ ID NO: 3809 - RNA, 23 nt, Homo Sapiens
uucuguuguuugcagaguugauc

SEQ ID NO: 3810 - RNA, 20 nt, Homo Sapiens
uuuucagucugcagaguaca

SEQ ID NO: 3811 - RNA, 20 nt, Homo Sapiens
uuuuuucgagucugcagagu

SEQ ID NO: 3812 - RNA, 20 nt, Homo Sapiens
uugcuugagcccagaguuca

SEQ ID NO: 3813 - RNA, 20 nt, Homo Sapiens
uuuauuagggaccugcagag

SEQ ID NO: 3814 - RNA, 21 nt, Homo Sapiens
uuucuuagcccacauauucau

SEQ ID NO: 3815 - RNA, 91 nt, Homo Sapiens
gaugguuuuagaugauaaccacaggucuacaagagcguuuuuaguaaagugccuguguucauuguggacaaaguuauuauuuugcaacauc

SEQ ID NO: 3816 - RNA, 24 nt, Homo Sapiens
uaaccacaggucuacaagagcguu

SEQ ID NO: 3817 - RNA, 19 nt, Homo Sapiens
aaccacaggauauuuacaa

SEQ ID NO: 3818 - RNA, 19 nt, Homo Sapiens
aaccacaggaaucccaaga

SEQ ID NO: 3819 - RNA, 21 nt, Homo Sapiens
aaccacaggugcgucaacagc

SEQ ID NO: 3820 - RNA, 22 nt, Homo Sapiens
aaccacagggcaagaccagagc

SEQ ID NO: 3821 - RNA, 16 nt, Homo Sapiens
aaccacaggucaagag

SEQ ID NO: 3822 - RNA, 19 nt, Homo Sapiens
acaaaguuauauuuauuuu

SEQ ID NO: 3823 - RNA, 19 nt, Homo Sapiens
acaugucuacaagcagcgu

SEQ ID NO: 3824 - RNA, 20 nt, Homo Sapiens
accccaggaagcuacaagag

SEQ ID NO: 3825 - RNA, 19 nt, Homo Sapiens
acuauagggauacaagagc

SEQ ID NO: 3826 - RNA, 21 nt, Homo Sapiens
accacagguuaccagaaccuu

SEQ ID NO: 3827 - RNA, 24 nt, Homo Sapiens
auuagugaacauuuuauuauuuug

SEQ ID NO: 3828 - RNA, 27 nt, Homo Sapiens
auuugagacaaauaauuuauuauuuug

SEQ ID NO: 3829 - RNA, 25 nt, Homo Sapiens
auugugagauaaauuuuauuauuuu

SEQ ID NO: 3830 - RNA, 22 nt, Homo Sapiens
auuuugacaaaguuaauuauuu

SEQ ID NO: 3831 - RNA, 21 nt, Homo Sapiens
augguacacaaaguuaauguu

SEQ ID NO: 3832 - RNA, 23 nt, Homo Sapiens
cacaggucuuauugaagaggguu

SEQ ID NO: 3833 - RNA, 20 nt, Homo Sapiens
ccaccaggucuacacggagc

SEQ ID NO: 3834 - RNA, 21 nt, Homo Sapiens
ggacaaaguuuccaagauuuu

SEQ ID NO: 3835 - RNA, 19 nt, Homo Sapiens
gggcaaaguuauuuuauuu

SEQ ID NO: 3836 - RNA, 20 nt, Homo Sapiens
guggaaaaagaauuauuuug

SEQ ID NO: 3837 - RNA, 24 nt, Homo Sapiens
uaaccacaggccaucuuuaaaaga

SEQ ID NO: 3838 - RNA, 23 nt, Homo Sapiens
uaaccacaggauuccccuagagc

SEQ ID NO: 3839 - RNA, 18 nt, Homo Sapiens
uaaccacugcuacaagag

SEQ ID NO: 3840 - RNA, 16 nt, Homo Sapiens
uaaccacagacagagc

SEQ ID NO: 3841 - RNA, 19 nt, Homo Sapiens
uggcaaagcauuauuauuu

SEQ ID NO: 3842 - RNA, 22 nt, Homo Sapiens
ugugacauaugucauuauuuug

SEQ ID NO: 3843 - RNA, 22 nt, Homo Sapiens
uuuuggcaacaaaguuauuuuu

SEQ ID NO: 3844 - RNA, 22 nt, Homo Sapiens
uuguggacacaacucaguauuu

SEQ ID NO: 3845 - RNA, 21 nt, Homo Sapiens
uucuugaauagcuauuauuuu

SEQ ID NO: 3846 - RNA, 21 nt, Homo Sapiens
uuggugccaaauuauuauuuu

SEQ ID NO: 3847 - RNA, 21 nt, Homo Sapiens
uuguggacagguauuauuuug

SEQ ID NO: 3848 - RNA, 60 nt, Homo Sapiens
gauguaaacacaaaagaaagugucucagcagggcugagcccuccuucucgugucugcauu

SEQ ID NO: 3849 - RNA, 24 nt, Homo Sapiens
uguaaacacaaaagaaagugucuc

SEQ ID NO: 3850 - RNA, 23 nt, Homo Sapiens
aaacaucaacuaaaaagugucuc

SEQ ID NO: 3851 - RNA, 22 nt, Homo Sapiens
aaacaagaagagaaaguguuuc

SEQ ID NO: 3852 - RNA, 20 nt, Homo Sapiens
aaacacaaaagagcaaaugu

SEQ ID NO: 3853 - RNA, 21 nt, Homo Sapiens
aaagacaaaagaaccuaucuc

SEQ ID NO: 3854 - RNA, 22 nt, Homo Sapiens
ugugaaacacaaaguagaaagu

SEQ ID NO: 3855 - RNA, 22 nt, Homo Sapiens
uggaaacuucaacaagaaagug

SEQ ID NO: 3856 - RNA, 19 nt, Homo Sapiens
uggaaaacaaaagaaaaug

SEQ ID NO: 3857 - RNA, 19 nt, Homo Sapiens
uguaaacucuaagaaagug

SEQ ID NO: 3858 - RNA, 85 nt, Homo Sapiens
gaugucaaugcugccauugccaccaucaaaacaagcgcagcauccaguuuguggauuggugccccacuggcuucaagguggcauc

SEQ ID NO: 3859 - RNA, 24 nt, Homo Sapiens
cauugccaccaucaaaacaagcgc

SEQ ID NO: 3860 - RNA, 20 nt, Homo Sapiens
auugccaccagcuaaaaaca

SEQ ID NO: 3861 - RNA, 19 nt, Homo Sapiens
auuccaauccucaaaacaa

SEQ ID NO: 3862 - RNA, 19 nt, Homo Sapiens
auugcuacagcaaaacaag

SEQ ID NO: 3863 - RNA, 19 nt, Homo Sapiens
auuucuaccaucaaaaaag

SEQ ID NO: 3864 - RNA, 21 nt, Homo Sapiens
auugugaccauuaacaagcgc

SEQ ID NO: 3865 - RNA, 18 nt, Homo Sapiens
cauuguccacaucaaaac

SEQ ID NO: 3866 - RNA, 21 nt, Homo Sapiens
cauuggcaguagccaucaaaa

SEQ ID NO: 3867 - RNA, 22 nt, Homo Sapiens
cauugccacauaccaaaauaag

SEQ ID NO: 3868 - RNA, 23 nt, Homo Sapiens
cagugcuacaaaucaaaacaugc

SEQ ID NO: 3869 - RNA, 21 nt, Homo Sapiens
cauugccaccuuugcagaaca

SEQ ID NO: 3870 - RNA, 23 nt, Homo Sapiens
cauuuucaacagacaaaacaagc

SEQ ID NO: 3871 - RNA, 24 nt, Homo Sapiens
cauugccacaagcugaaaaagaag

SEQ ID NO: 3872 - RNA, 19 nt, Homo Sapiens
caugcccaccaucaccaca

SEQ ID NO: 3873 - RNA, 19 nt, Homo Sapiens
cauuguauucaucaaaaca

SEQ ID NO: 3874 - RNA, 20 nt, Homo Sapiens
caaugcgagggucaaaacaa

SEQ ID NO: 3875 - RNA, 20 nt, Homo Sapiens
caucacccucaucaaaacaa

SEQ ID NO: 3876 - RNA, 20 nt, Homo Sapiens
cauuucuaccucaaaacaag

SEQ ID NO: 3877 - RNA, 22 nt, Homo Sapiens
gccagccaucaaaaaugaagcg

SEQ ID NO: 3878 - RNA, 19 nt, Homo Sapiens
gccaccaucccaaacaugc

SEQ ID NO: 3879 - RNA, 19 nt, Homo Sapiens
gccccaaccaaaacaagcg

SEQ ID NO: 3880 - RNA, 20 nt, Homo Sapiens
gcccacuuuaaaacaagcgc

SEQ ID NO: 3881 - RNA, 20 nt, Homo Sapiens
uuaccuacaucaaaacuaag

SEQ ID NO: 3882 - RNA, 19 nt, Homo Sapiens
uugccaccaccuaccaagc

SEQ ID NO: 3883 - RNA, 20 nt, Homo Sapiens
uugucaccuaaaaaacaagc

SEQ ID NO: 3884 - RNA, 60 nt, Homo Sapiens
gauuagcucauuugaagaauaccacaacagugguuuuaaacauuuuugaauugacuaguc

SEQ ID NO: 3885 - RNA, 24 nt, Homo Sapiens
uagcucauuugaagaauaccacaa

SEQ ID NO: 3886 - RNA, 24 nt, Homo Sapiens
agcuucuuuucaaugaauaccaca

SEQ ID NO: 3887 - RNA, 24 nt, Homo Sapiens
agcucauuugcaugcaugcaaaaa

SEQ ID NO: 3888 - RNA, 22 nt, Homo Sapiens
agcucauuuaaaaagggaauac

SEQ ID NO: 3889 - RNA, 19 nt, Homo Sapiens
aguucccuuaagaauacca

SEQ ID NO: 3890 - RNA, 23 nt, Homo Sapiens
agcucauuuguagacuugcaaaa

SEQ ID NO: 3891 - RNA, 23 nt, Homo Sapiens
agcuuuuuugaagaaaacaaaaa

SEQ ID NO: 3892 - RNA, 19 nt, Homo Sapiens
auuugaagaaauauuacaa

SEQ ID NO: 3893 - RNA, 19 nt, Homo Sapiens
cauaugaagaauaaacaca

SEQ ID NO: 3894 - RNA, 19 nt, Homo Sapiens
cucauuugaaguuacucac

SEQ ID NO: 3895 - RNA, 20 nt, Homo Sapiens
gcacauuuugaagaacacaa

SEQ ID NO: 3896 - RNA, 22 nt, Homo Sapiens
gcucauuuggaguuuaauacca

SEQ ID NO: 3897 - RNA, 23 nt, Homo Sapiens
ucauuugaugaagaauaacucaa

SEQ ID NO: 3898 - RNA, 17 nt, Homo Sapiens
ucauuaagaauacccaa

SEQ ID NO: 3899 - RNA, 67 nt, Homo Sapiens
gauugaccucccugaagcccaagccaaucugucccagcuccgggaucacuugggacaggaggucauc

SEQ ID NO: 3900 - RNA, 22 nt, Homo Sapiens
ucacuugggacaggaggucauc

SEQ ID NO: 3901 - RNA, 19 nt, Homo Sapiens
acugggugacaggagggca

SEQ ID NO: 3902 - RNA, 19 nt, Homo Sapiens
ucacuugggcccaagaggu

SEQ ID NO: 3903 - RNA, 22 nt, Homo Sapiens
ucacuugggcccagcaggccau

SEQ ID NO: 3904 - RNA, 24 nt, Homo Sapiens
ucacuugggaagcccaagggguca

SEQ ID NO: 3905 - RNA, 24 nt, Homo Sapiens
ucacaucgaaccgcaggaggucau

SEQ ID NO: 3906 - RNA, 21 nt, Homo Sapiens
ucgcuugagccuaggagguca

SEQ ID NO: 3907 - RNA, 19 nt, Homo Sapiens
ucacuugaaccaggagguc

SEQ ID NO: 3908 - RNA, 20 nt, Homo Sapiens
ucaccuaggucaggagguca

SEQ ID NO: 3909 - RNA, 98 nt, Homo Sapiens
gauuugacacugcaggcagaugaggucuugggaugccucuugcguucccccuucugugggagcaggugccuucccaaccucagcacucagucccaauc

SEQ ID NO: 3910 - RNA, 24 nt, Homo Sapiens
ugaggucuugggaugccucuugcg

SEQ ID NO: 3911 - RNA, 21 nt, Homo Sapiens
aggucuugguggaugucccuu

SEQ ID NO: 3912 - RNA, 17 nt, Homo Sapiens
aggucuuggcacucuug

SEQ ID NO: 3913 - RNA, 19 nt, Homo Sapiens
ggucuuggguugugacuug

SEQ ID NO: 3914 - RNA, 22 nt, Homo Sapiens
ucuugccaaggcugccucuugc

SEQ ID NO: 3915 - RNA, 20 nt, Homo Sapiens
ugaggucuugcuaugaugcc

SEQ ID NO: 3916 - RNA, 21 nt, Homo Sapiens
ugaggucuugcuauguuuugc

SEQ ID NO: 3917 - RNA, 85 nt, Homo Sapiens
gcaagacacuaggcugucccgaaccccugguaauagaauuguuuaccuuuauaccaagaagaguugggaaagcaccaaaaucugc

SEQ ID NO: 3918 - RNA, 24 nt, Homo Sapiens
uaccaagaagaguugggaaagcac

SEQ ID NO: 3919 - RNA, 24 nt, Homo Sapiens
aagaaguacuccccugggaaagca

SEQ ID NO: 3920 - RNA, 17 nt, Homo Sapiens
caagaagaguuagaagc

SEQ ID NO: 3921 - RNA, 16 nt, Homo Sapiens
ccaagaagaggguaag

SEQ ID NO: 3922 - RNA, 62 nt, Homo Sapiens
gcaagucuucuuagagcuggggccaagugacuucuccuugacuccucugagcaaagcccagc

SEQ ID NO: 3923 - RNA, 24 nt, Homo Sapiens
caagucuucuuagagcuggggcca

SEQ ID NO: 3924 - RNA, 23 nt, Homo Sapiens
aaguuccuucauggcuggggcca

SEQ ID NO: 3925 - RNA, 23 nt, Homo Sapiens
aaggcuucagggaggcuggggcc

SEQ ID NO: 3926 - RNA, 19 nt, Homo Sapiens
aagcuuuucggagcugggg

SEQ ID NO: 3927 - RNA, 19 nt, Homo Sapiens
aaguugcugagagcugggg

SEQ ID NO: 3928 - RNA, 20 nt, Homo Sapiens
aagucuucuuaaacuugggg

SEQ ID NO: 3929 - RNA, 22 nt, Homo Sapiens
aagccuggguggagcuggggcc

SEQ ID NO: 3930 - RNA, 21 nt, Homo Sapiens
agugcaucuugcagcuggggc

SEQ ID NO: 3931 - RNA, 23 nt, Homo Sapiens
agccuucuuagagacuggaucca

SEQ ID NO: 3932 - RNA, 21 nt, Homo Sapiens
agcccucguagacuggggcca

SEQ ID NO: 3933 - RNA, 24 nt, Homo Sapiens
caaggccuucucagcagcuggggc

SEQ ID NO: 3934 - RNA, 19 nt, Homo Sapiens
caaucuguuuuagagcugg

SEQ ID NO: 3935 - RNA, 19 nt, Homo Sapiens
caaaacuucuuagaugcug

SEQ ID NO: 3936 - RNA, 17 nt, Homo Sapiens
caaguuucagagcuggg

SEQ ID NO: 3937 - RNA, 21 nt, Homo Sapiens
caagugucucagagcuggggc

SEQ ID NO: 3938 - RNA, 20 nt, Homo Sapiens
caagucuucaccuggagcca

SEQ ID NO: 3939 - RNA, 22 nt, Homo Sapiens
cuucuuuccagcacuggggcca

SEQ ID NO: 3940 - RNA, 19 nt, Homo Sapiens
cuucauccagagcuggggc

SEQ ID NO: 3941 - RNA, 21 nt, Homo Sapiens
gucucccugucagagcugggg

SEQ ID NO: 3942 - RNA, 21 nt, Homo Sapiens
gucuucuuagggaucaugggg

SEQ ID NO: 3943 - RNA, 20 nt, Homo Sapiens
ucuuaaagggacuggggcca

SEQ ID NO: 3944 - RNA, 19 nt, Homo Sapiens
ucuucaguaggcuggggcc

SEQ ID NO: 3945 - RNA, 20 nt, Homo Sapiens
ucaucucggggcuggggcca

SEQ ID NO: 3946 - RNA, 20 nt, Homo Sapiens
uccugucagagcugggccca

SEQ ID NO: 3947 - RNA, 61 nt, Homo Sapiens
gcaagugccuccggacauguggaucacaggcuacuagaaaccacgaguucccuccauuugu

SEQ ID NO: 3948 - RNA, 24 nt, Homo Sapiens
agaaaccacgaguucccuccauuu

SEQ ID NO: 3949 - RNA, 20 nt, Homo Sapiens
aaccucgcaugguucccucc

SEQ ID NO: 3950 - RNA, 20 nt, Homo Sapiens
agaaaccacucacugccucc

SEQ ID NO: 3951 - RNA, 18 nt, Homo Sapiens
agaaaguaaguucccucc

SEQ ID NO: 3952 - RNA, 19 nt, Homo Sapiens
agaaaccacuggcccugca

SEQ ID NO: 3953 - RNA, 21 nt, Homo Sapiens
aggaaggaagacuucccucca

SEQ ID NO: 3954 - RNA, 22 nt, Homo Sapiens
agaaaugaagaucucccuccau

SEQ ID NO: 3955 - RNA, 19 nt, Homo Sapiens
agaaacaggucccuccauu

SEQ ID NO: 3956 - RNA, 22 nt, Homo Sapiens
gaaaaugaauuccccuccauuu

SEQ ID NO: 3957 - RNA, 17 nt, Homo Sapiens
gaaaacacuucccucca

SEQ ID NO: 3958 - RNA, 20 nt, Homo Sapiens
gaauucacggcuucccucca

SEQ ID NO: 3959 - RNA, 20 nt, Homo Sapiens
gauacccaguguucccucca

SEQ ID NO: 3960 - RNA, 19 nt, Homo Sapiens
gaaaaugaguucccuucau

SEQ ID NO: 3961 - RNA, 66 nt, Homo Sapiens
gcaaugccagguucaguagccguccccccggaaaggggugaccuuuaugcucgugcuugauguugc

SEQ ID NO: 3962 - RNA, 24 nt, Homo Sapiens
ugccagguucaguagccguccccc

SEQ ID NO: 3963 - RNA, 15 nt, Homo Sapiens
agguucagugucccc

SEQ ID NO: 3964 - RNA, 22 nt, Homo Sapiens
caggugaugaggggccgucccc

SEQ ID NO: 3965 - RNA, 20 nt, Homo Sapiens
cagguucaguacugcccucc

SEQ ID NO: 3966 - RNA, 20 nt, Homo Sapiens
cagguucagaagccaugucc

SEQ ID NO: 3967 - RNA, 17 nt, Homo Sapiens
ccagguucauucccucc

SEQ ID NO: 3968 - RNA, 19 nt, Homo Sapiens
ccagguucagguuccuccc

SEQ ID NO: 3969 - RNA, 23 nt, Homo Sapiens
gccagguucucagcagcaggccc

SEQ ID NO: 3970 - RNA, 21 nt, Homo Sapiens
gccgcuccagcagccgucccc

SEQ ID NO: 3971 - RNA, 20 nt, Homo Sapiens
gccagggaguggccgucccc

SEQ ID NO: 3972 - RNA, 20 nt, Homo Sapiens
ugacagcuugcucaguagcc

SEQ ID NO: 3973 - RNA, 19 nt, Homo Sapiens
ugccagguugaaaagucgu

SEQ ID NO: 3974 - RNA, 19 nt, Homo Sapiens
ugccagguucuagcccucc

SEQ ID NO: 3975 - RNA, 24 nt, Homo Sapiens
ugccugagucauucuccguccccc

SEQ ID NO: 3976 - RNA, 19 nt, Homo Sapiens
uuaaguaaaagccgucccc

SEQ ID NO: 3977 - RNA, 68 nt, Homo Sapiens
gcaauguaauuugaaaucaguugaauuuccuguuuuucucucauagguucaacuacucaauuucaugc

SEQ ID NO: 3978 - RNA, 24 nt, Homo Sapiens
uguaauuugaaaucaguugaauuu

SEQ ID NO: 3979 - RNA, 19 nt, Homo Sapiens
guagacuucaaaucaguug

SEQ ID NO: 3980 - RNA, 24 nt, Homo Sapiens
uaauuuaugaaaucagaauggaau

SEQ ID NO: 3981 - RNA, 20 nt, Homo Sapiens
uaauuugaaauugguuugaa

SEQ ID NO: 3982 - RNA, 16 nt, Homo Sapiens
uaauuugaaaucugaa

SEQ ID NO: 3983 - RNA, 20 nt, Homo Sapiens
uauuaugaagucaguugaau

SEQ ID NO: 3984 - RNA, 22 nt, Homo Sapiens
uguaauuugaugaauuauucaa

SEQ ID NO: 3985 - RNA, 23 nt, Homo Sapiens
uguaauuugagaaggauugugaa

SEQ ID NO: 3986 - RNA, 25 nt, Homo Sapiens
ugaaauuugaaauccaaauguauuu

SEQ ID NO: 3987 - RNA, 24 nt, Homo Sapiens
uguaauuugaaagcagauuaacuu

SEQ ID NO: 3988 - RNA, 83 nt, Homo Sapiens
gcacuuuuaacuuuucgccauggaacaacgacccuaaagaaaggauaaaagggggcaguugccaugcuggaacgugaaaaggc

SEQ ID NO: 3989 - RNA, 24 nt, Homo Sapiens
uuuaacuuuucgccauggaacaac

SEQ ID NO: 3990 - RNA, 20 nt, Homo Sapiens
aacuuaguugaccauggaac

SEQ ID NO: 3991 - RNA, 18 nt, Homo Sapiens
ccaugcuccacgugaaaa

SEQ ID NO: 3992 - RNA, 21 nt, Homo Sapiens
ccauacuuuauugugaaaagg

SEQ ID NO: 3993 - RNA, 20 nt, Homo Sapiens
ccaugcuggacuugagaggg

SEQ ID NO: 3994 - RNA, 17 nt, Homo Sapiens
gccaugcugaugaaaag

SEQ ID NO: 3995 - RNA, 18 nt, Homo Sapiens
uggcaugguaacgugaaa

SEQ ID NO: 3996 - RNA, 18 nt, Homo Sapiens
uuaacuuuucccaugaaa

SEQ ID NO: 3997 - RNA, 19 nt, Homo Sapiens
uuaacuuuuguaaugaaac

SEQ ID NO: 3998 - RNA, 22 nt, Homo Sapiens
uuaacuuuuccacuugaaaaaa

SEQ ID NO: 3999 - RNA, 27 nt, Homo Sapiens
uugcaugcuggaauuucacugaaaagg

SEQ ID NO: 4000 - RNA, 24 nt, Homo Sapiens
uugccaugcaagaaugggaacagg

SEQ ID NO: 4001 - RNA, 28 nt, Homo Sapiens
uuuaacuuucuuucuggcacaggaacaa

SEQ ID NO: 4002 - RNA, 24 nt, Homo Sapiens
uuuaacuuuuaucuaccugaaaca

SEQ ID NO: 4003 - RNA, 25 nt, Homo Sapiens
uuuaacuuuaugcaccaaggaagaa

SEQ ID NO: 4004 - RNA, 24 nt, Homo Sapiens
uuuaauauuagcauucauggaaca

SEQ ID NO: 4005 - RNA, 22 nt, Homo Sapiens
uuuaacuuuuuacaaaggagca

SEQ ID NO: 4006 - RNA, 19 nt, Homo Sapiens
uuuaacuuuuugaugaaca

SEQ ID NO: 4007 - RNA, 80 nt, Homo Sapiens
gcagaauugaagaugggaaguucauugggacugugucuuggaaaagcaccaaguucgucucaguuguuccuguuuuuugc

SEQ ID NO: 4008 - RNA, 24 nt, Homo Sapiens
ugggaaguucauugggacuguguc

SEQ ID NO: 4009 - RNA, 18 nt, Homo Sapiens
aagcucccuggacugugu

SEQ ID NO: 4010 - RNA, 18 nt, Homo Sapiens
aaguucauuugcaugugu

SEQ ID NO: 4011 - RNA, 19 nt, Homo Sapiens
gaaguucaucugauacugu

SEQ ID NO: 4012 - RNA, 22 nt, Homo Sapiens
ggaaguucaaagugauuauguc

SEQ ID NO: 4013 - RNA, 20 nt, Homo Sapiens
gguaagagcgaugggacugu

SEQ ID NO: 4014 - RNA, 21 nt, Homo Sapiens
ugggaaguugccauuuuggga

SEQ ID NO: 4015 - RNA, 18 nt, Homo Sapiens
ugggaaguugugcgacug

SEQ ID NO: 4016 - RNA, 18 nt, Homo Sapiens
ugggaaguuccgggccug

SEQ ID NO: 4017 - RNA, 19 nt, Homo Sapiens
ugugaugucagggacugug

SEQ ID NO: 4018 - RNA, 94 nt, Homo Sapiens
gcagagcuuguguaggaagaaugaaaucugcaauuugacuuuuaggagugucguuuuccgggucaggcagauugguauucagcgcuggcucugc

SEQ ID NO: 4019 - RNA, 24 nt, Homo Sapiens
ugaaaucugcaauuugacuuuuag

SEQ ID NO: 4020 - RNA, 21 nt, Homo Sapiens
aaaucaccugcaauuuuacuu

SEQ ID NO: 4021 - RNA, 24 nt, Homo Sapiens
aaaucugcauaauauugaguuuua

SEQ ID NO: 4022 - RNA, 23 nt, Homo Sapiens
aaaucugcacuuuugacuguaag

SEQ ID NO: 4023 - RNA, 18 nt, Homo Sapiens
aaaucagcuuuugacuuu

SEQ ID NO: 4024 - RNA, 20 nt, Homo Sapiens
aaaacuguauuugacuuuua

SEQ ID NO: 4025 - RNA, 19 nt, Homo Sapiens
aaauauguauugacuuuua

SEQ ID NO: 4026 - RNA, 22 nt, Homo Sapiens
aaaucugcaauuuagguuucag

SEQ ID NO: 4027 - RNA, 23 nt, Homo Sapiens
aaacugaaacaugugacuuuuag

SEQ ID NO: 4028 - RNA, 24 nt, Homo Sapiens
aaucugcaauuaugaucauuguag

SEQ ID NO: 4029 - RNA, 19 nt, Homo Sapiens
aagcugcaauuuuacauuu

SEQ ID NO: 4030 - RNA, 17 nt, Homo Sapiens
aaucugcaauuucuuuu

SEQ ID NO: 4031 - RNA, 18 nt, Homo Sapiens
gaaaucugcauuucuuuu

SEQ ID NO: 4032 - RNA, 20 nt, Homo Sapiens
gaaaucugcauuaauuuuag

SEQ ID NO: 4033 - RNA, 23 nt, Homo Sapiens
gaaaucugcaucuuuccuuuuag

SEQ ID NO: 4034 - RNA, 19 nt, Homo Sapiens
ugagaaucugcaauuuacu

SEQ ID NO: 4035 - RNA, 21 nt, Homo Sapiens
ugaaauuaaacuugacuuuua

SEQ ID NO: 4036 - RNA, 21 nt, Homo Sapiens
uguaauauauuuugacuuuua

SEQ ID NO: 4037 - RNA, 24 nt, Homo Sapiens
ugaaggcagacauuugacuuuaag

SEQ ID NO: 4038 - RNA, 67 nt, Homo Sapiens
gcagccgcuuuggaugcucuucggccugcacgggaccaucacgcagauccgcauccucggugagugc

SEQ ID NO: 4039 - RNA, 24 nt, Homo Sapiens
ucacgcagauccgcauccucggug

SEQ ID NO: 4040 - RNA, 25 nt, Homo Sapiens
acgcagggccgccgccuccucggug

SEQ ID NO: 4041 - RNA, 24 nt, Homo Sapiens
cacugcagggccccagcauccucg

SEQ ID NO: 4042 - RNA, 20 nt, Homo Sapiens
cacagagauccgcaguccuc

SEQ ID NO: 4043 - RNA, 18 nt, Homo Sapiens
cacgcagauacgcucucg

SEQ ID NO: 4044 - RNA, 18 nt, Homo Sapiens
cgcgaacacgcauccucg

SEQ ID NO: 4045 - RNA, 19 nt, Homo Sapiens
cgcugcgccgcauccucgg

SEQ ID NO: 4046 - RNA, 26 nt, Homo Sapiens
ucacagcagauccgaguccacgugug

SEQ ID NO: 4047 - RNA, 20 nt, Homo Sapiens
ucacgcagaccucucuuggg

SEQ ID NO: 4048 - RNA, 21 nt, Homo Sapiens
ucacgcagauggcaacugggu

SEQ ID NO: 4049 - RNA, 20 nt, Homo Sapiens
ucacgcagacgucuucagug

SEQ ID NO: 4050 - RNA, 22 nt, Homo Sapiens
ucacgcagacagugcccuggug

SEQ ID NO: 4051 - RNA, 21 nt, Homo Sapiens
ucacggauaucguccucggug

SEQ ID NO: 4052 - RNA, 81 nt, Homo Sapiens
gcaggagcgggggggaaucauugaccuugaggcugagcgaaaccgauacuucaucagccuucagcagccuccugccccugc

SEQ ID NO: 4053 - RNA, 24 nt, Homo Sapiens
ucagccuucagcagccuccugccc

SEQ ID NO: 4054 - RNA, 18 nt, Homo Sapiens
agccuucagagacuccug

SEQ ID NO: 4055 - RNA, 22 nt, Homo Sapiens
cagccgcuucagagccuccugc

SEQ ID NO: 4056 - RNA, 19 nt, Homo Sapiens
cagccuugaacagccuccu

SEQ ID NO: 4057 - RNA, 21 nt, Homo Sapiens
cagccuuggucccuccugccc

SEQ ID NO: 4058 - RNA, 20 nt, Homo Sapiens
cauugaccuuugggugcuga

SEQ ID NO: 4059 - RNA, 20 nt, Homo Sapiens
cacugccugaggcugaggga

SEQ ID NO: 4060 - RNA, 20 nt, Homo Sapiens
cuucauccagacuccugccc

SEQ ID NO: 4061 - RNA, 19 nt, Homo Sapiens
gcccucgcagccuccgccc

SEQ ID NO: 4062 - RNA, 19 nt, Homo Sapiens
ucagccuucugcugccccc

SEQ ID NO: 4063 - RNA, 20 nt, Homo Sapiens
ucagccuucggcccucccgc

SEQ ID NO: 4064 - RNA, 20 nt, Homo Sapiens
ucacuaccuugaggccgugc

SEQ ID NO: 4065 - RNA, 19 nt, Homo Sapiens
ugagcccugaggcugagcg

SEQ ID NO: 4066 - RNA, 21 nt, Homo Sapiens
uuguccuuggggaggcugagc

SEQ ID NO: 4067 - RNA, 20 nt, Homo Sapiens
uucaccaugaggcugaggaa

SEQ ID NO: 4068 - RNA, 60 nt, Homo Sapiens
gcaggaugauugaggaugcaauucgaagucacagcgaaucagccucaccuucagcccugu

SEQ ID NO: 4069 - RNA, 22 nt, Homo Sapiens
ucagccucaccuucagcccugu

SEQ ID NO: 4070 - RNA, 20 nt, Homo Sapiens
agccucaccauccaccucug

SEQ ID NO: 4071 - RNA, 20 nt, Homo Sapiens
aggagauaauggaugcaauu

SEQ ID NO: 4072 - RNA, 20 nt, Homo Sapiens
aucaucugaggaugcaauuc

SEQ ID NO: 4073 - RNA, 21 nt, Homo Sapiens
augauugagaaaaugaauucg

SEQ ID NO: 4074 - RNA, 19 nt, Homo Sapiens
augauacagugaugcaauu

SEQ ID NO: 4075 - RNA, 19 nt, Homo Sapiens
cagccucacccuucgcucu

SEQ ID NO: 4076 - RNA, 23 nt, Homo Sapiens
cagccaccccuucagccuccugu

SEQ ID NO: 4077 - RNA, 19 nt, Homo Sapiens
cagcaacagcuucagcccu

SEQ ID NO: 4078 - RNA, 19 nt, Homo Sapiens
cagccucacauucagaccu

SEQ ID NO: 4079 - RNA, 17 nt, Homo Sapiens
cagcccacucagcccug

SEQ ID NO: 4080 - RNA, 20 nt, Homo Sapiens
caucuucauccucagcccug

SEQ ID NO: 4081 - RNA, 22 nt, Homo Sapiens
caggaaccuaaaugaggaugca

SEQ ID NO: 4082 - RNA, 24 nt, Homo Sapiens
caggacucaauaagggaugcaauu

SEQ ID NO: 4083 - RNA, 25 nt, Homo Sapiens
cagguuggagugcagugaugcaauu

SEQ ID NO: 4084 - RNA, 25 nt, Homo Sapiens
caggaugauuagguggaccugcaau

SEQ ID NO: 4085 - RNA, 23 nt, Homo Sapiens
cagaauaauuuugagaugcaauu

SEQ ID NO: 4086 - RNA, 18 nt, Homo Sapiens
caggagguugaggaugca

SEQ ID NO: 4087 - RNA, 18 nt, Homo Sapiens
cagggagggaggaugcaa

SEQ ID NO: 4088 - RNA, 20 nt, Homo Sapiens
caggaugauaaagaaugaau

SEQ ID NO: 4089 - RNA, 21 nt, Homo Sapiens
caggucagugaugaugcaauu

SEQ ID NO: 4090 - RNA, 19 nt, Homo Sapiens
gccucgcuuaucagcccug

SEQ ID NO: 4091 - RNA, 21 nt, Homo Sapiens
gcuucaccuucaaggccuugu

SEQ ID NO: 4092 - RNA, 17 nt, Homo Sapiens
gccuccuucagccgcug

SEQ ID NO: 4093 - RNA, 22 nt, Homo Sapiens
ggauauuacaagaaugcaauuc

SEQ ID NO: 4094 - RNA, 18 nt, Homo Sapiens
ggguguugaggauggaau

SEQ ID NO: 4095 - RNA, 20 nt, Homo Sapiens
ggaugauuguaaagcaaauc

SEQ ID NO: 4096 - RNA, 19 nt, Homo Sapiens
ucaggucucuccuucagcc

SEQ ID NO: 4097 - RNA, 24 nt, Homo Sapiens
ucagccucacauacccugcagccc

SEQ ID NO: 4098 - RNA, 28 nt, Homo Sapiens
ucagccucauccuccccaggaccccugu

SEQ ID NO: 4099 - RNA, 22 nt, Homo Sapiens
ucagccucaccccucuagcccu

SEQ ID NO: 4100 - RNA, 19 nt, Homo Sapiens
ucagccucagcccccaccc

SEQ ID NO: 4101 - RNA, 24 nt, Homo Sapiens
ucggccucaccucucugcuccugu

SEQ ID NO: 4102 - RNA, 22 nt, Homo Sapiens
ucacccccaccuucagcuccug

SEQ ID NO: 4103 - RNA, 18 nt, Homo Sapiens
ucagccucagcccacccu

SEQ ID NO: 4104 - RNA, 74 nt, Homo Sapiens
gcaguggagggggcaggaccuccugcuggugcagcaccagcugcugugagcagguccaccggccccuacacugc

SEQ ID NO: 4105 - RNA, 24 nt, Homo Sapiens
ugugagcagguccaccggccccua

SEQ ID NO: 4106 - RNA, 18 nt, Homo Sapiens
agcggucggccggccccu

SEQ ID NO: 4107 - RNA, 21 nt, Homo Sapiens
gagcaggucggccaggccacu

SEQ ID NO: 4108 - RNA, 19 nt, Homo Sapiens
gagcaggucaucagggccc

SEQ ID NO: 4109 - RNA, 19 nt, Homo Sapiens
gagcaggucuccuggcucc

SEQ ID NO: 4110 - RNA, 24 nt, Homo Sapiens
gugggcagguccagcagugccacu

SEQ ID NO: 4111 - RNA, 23 nt, Homo Sapiens
gugagcagguguacucgccaccu

SEQ ID NO: 4112 - RNA, 22 nt, Homo Sapiens
gugagcaggccuagcagggccc

SEQ ID NO: 4113 - RNA, 21 nt, Homo Sapiens
gugagcaggggcaccaggucc

SEQ ID NO: 4114 - RNA, 26 nt, Homo Sapiens
ugaggcaaguccuagaccggccccua

SEQ ID NO: 4115 - RNA, 18 nt, Homo Sapiens
ugugagcagggucccggc

SEQ ID NO: 4116 - RNA, 21 nt, Homo Sapiens
ugugagcaggauccuggggcc

SEQ ID NO: 4117 - RNA, 22 nt, Homo Sapiens
ugugagcagacccgacuggccc

SEQ ID NO: 4118 - RNA, 23 nt, Homo Sapiens
ugggagcagguccuuccagcccc

SEQ ID NO: 4119 - RNA, 23 nt, Homo Sapiens
ugugagcagugcaccugggcucu

SEQ ID NO: 4120 - RNA, 19 nt, Homo Sapiens
ugugagcaggagcagccgc

SEQ ID NO: 4121 - RNA, 18 nt, Homo Sapiens
ugugagcagcaguggccc

SEQ ID NO: 4122 - RNA, 20 nt, Homo Sapiens
ugugagcagcucacaggccc

SEQ ID NO: 4123 - RNA, 19 nt, Homo Sapiens
ugucagcagguccagcccc

SEQ ID NO: 4124 - RNA, 21 nt, Homo Sapiens
ugugagcagggccaaggcucc

SEQ ID NO: 4125 - RNA, 63 nt, Homo Sapiens
gcauaugaggacggccauuauuguugggggcaaauggaaaugcucuaggcggggccgcguagc

SEQ ID NO: 4126 - RNA, 24 nt, Homo Sapiens
uaugaggacggccauuauuguugg

SEQ ID NO: 4127 - RNA, 19 nt, Homo Sapiens
aguacugccauuauuauug

SEQ ID NO: 4128 - RNA, 20 nt, Homo Sapiens
augaggacugaccauuauug

SEQ ID NO: 4129 - RNA, 21 nt, Homo Sapiens
gaggacggccagggacuguug

SEQ ID NO: 4130 - RNA, 24 nt, Homo Sapiens
uaucaugauggaaucauuauuguu

SEQ ID NO: 4131 - RNA, 19 nt, Homo Sapiens
uaugaggacuggaauuuuu

SEQ ID NO: 4132 - RNA, 22 nt, Homo Sapiens
uaggaggagcuucauuauuguu

SEQ ID NO: 4133 - RNA, 22 nt, Homo Sapiens
uaugaggacguccagcaauguu

SEQ ID NO: 4134 - RNA, 21 nt, Homo Sapiens
uaugaacuccaauuauuguug

SEQ ID NO: 4135 - RNA, 21 nt, Homo Sapiens
ugacgacagggccauuauagu

SEQ ID NO: 4136 - RNA, 19 nt, Homo Sapiens
ugaagaugcuuuauuguug

SEQ ID NO: 4137 - RNA, 67 nt, Homo Sapiens
gcaucagaguaaucuucaguguggaauguuaaauaacgcuuuuauacuguauuuuguacuaugaugu

SEQ ID NO: 4138 - RNA, 24 nt, Homo Sapiens
ucagaguaaucuucaguguggaau

SEQ ID NO: 4139 - RNA, 19 nt, Homo Sapiens
aagcuuccacaguguggaa

SEQ ID NO: 4140 - RNA, 20 nt, Homo Sapiens
guaaucuucgagagcucgaa

SEQ ID NO: 4141 - RNA, 19 nt, Homo Sapiens
ucagaguaacucugaucag

SEQ ID NO: 4142 - RNA, 61 nt, Homo Sapiens
gcaucuaaugugauaaggcugcacguuuuauaucgauggucauucuuuauuguauuggugc

SEQ ID NO: 4143 - RNA, 24 nt, Homo Sapiens
ucuaaugugauaaggcugcacguu

SEQ ID NO: 4144 - RNA, 21 nt, Homo Sapiens
aaggugacaggugcugcacgu

SEQ ID NO: 4145 - RNA, 21 nt, Homo Sapiens
augugauaauacaugcccguu

SEQ ID NO: 4146 - RNA, 20 nt, Homo Sapiens
auguaacaaaccugcacguu

SEQ ID NO: 4147 - RNA, 22 nt, Homo Sapiens
cuaaugugaaaagaaacugcac

SEQ ID NO: 4148 - RNA, 19 nt, Homo Sapiens
cuaaugugauuugacugca

SEQ ID NO: 4149 - RNA, 20 nt, Homo Sapiens
cuuaugugauaaugguguac

SEQ ID NO: 4150 - RNA, 19 nt, Homo Sapiens
uacuguguccaggcugcac

SEQ ID NO: 4151 - RNA, 20 nt, Homo Sapiens
uaagcugaaaggcugcaagu

SEQ ID NO: 4152 - RNA, 20 nt, Homo Sapiens
ucuauucugccauaaggcug

SEQ ID NO: 4153 - RNA, 23 nt, Homo Sapiens
ucuacgugcauaaggcugaaagu

SEQ ID NO: 4154 - RNA, 18 nt, Homo Sapiens
ucuaaugugcagacugca

SEQ ID NO: 4155 - RNA, 19 nt, Homo Sapiens
ucuuagguaaaaggcugca

SEQ ID NO: 4156 - RNA, 20 nt, Homo Sapiens
ugugcaggaggcugcacguu

SEQ ID NO: 4157 - RNA, 66 nt, Homo Sapiens
gcaugaggaagauaauccuuugaaacaucauuaauugaagugauuuuaaauaggauuuccuuuugu

SEQ ID NO: 4158 - RNA, 24 nt, Homo Sapiens
ugaggaagauaauccuuugaaaca

SEQ ID NO: 4159 - RNA, 19 nt, Homo Sapiens
aagauaaauuuccuuugaa

SEQ ID NO: 4160 - RNA, 24 nt, Homo Sapiens
agcaggauaauccuauuggcaaac

SEQ ID NO: 4161 - RNA, 21 nt, Homo Sapiens
agaaauaucaucuuugaaaca

SEQ ID NO: 4162 - RNA, 25 nt, Homo Sapiens
gagggagaggaaacccuuugaaaca

SEQ ID NO: 4163 - RNA, 25 nt, Homo Sapiens
gaggaagaucaaacuuuauugaaac

SEQ ID NO: 4164 - RNA, 27 nt, Homo Sapiens
ugaggaagaauaagcccuuuuguuaca

SEQ ID NO: 4165 - RNA, 20 nt, Homo Sapiens
ugaggaagaguaauuugaaa

SEQ ID NO: 4166 - RNA, 20 nt, Homo Sapiens
ugaggaagauauuuccugug

SEQ ID NO: 4167 - RNA, 23 nt, Homo Sapiens
ugaggaagaaaauaccauuaaaa

SEQ ID NO: 4168 - RNA, 25 nt, Homo Sapiens
ugaggagggucguuccuuugaaaca

SEQ ID NO: 4169 - RNA, 26 nt, Homo Sapiens
ugugaaagauaucacacuuugaaaca

SEQ ID NO: 4170 - RNA, 25 nt, Homo Sapiens
ugagcaaauaauccuuuaugauaca

SEQ ID NO: 4171 - RNA, 18 nt, Homo Sapiens
ugaggaagaagcccuuug

SEQ ID NO: 4172 - RNA, 19 nt, Homo Sapiens
ugaggaagaaaaucucuga

SEQ ID NO: 4173 - RNA, 20 nt, Homo Sapiens
ugaggaagaagagccuugaa

SEQ ID NO: 4174 - RNA, 22 nt, Homo Sapiens
ugaggaagaaaaucucuuguaa

SEQ ID NO: 4175 - RNA, 22 nt, Homo Sapiens
ugaggcaaauaacccuuugaaa

SEQ ID NO: 4176 - RNA, 23 nt, Homo Sapiens
ugagaagauaauucuuauaaaca

SEQ ID NO: 4177 - RNA, 70 nt, Homo Sapiens
gcauggccagggagggcaaauggaaaggcaaccacucucugccgguccugggcuuaucccugcaaugugc

SEQ ID NO: 4178 - RNA, 24 nt, Homo Sapiens
uggccagggagggcaaauggaaag

SEQ ID NO: 4179 - RNA, 19 nt, Homo Sapiens
aggaacggaaaauggaaag

SEQ ID NO: 4180 - RNA, 22 nt, Homo Sapiens
cagggagggaacggaagggaaa

SEQ ID NO: 4181 - RNA, 17 nt, Homo Sapiens
cagggagggaaggaaag

SEQ ID NO: 4182 - RNA, 17 nt, Homo Sapiens
cagggagggaaagaaag

SEQ ID NO: 4183 - RNA, 23 nt, Homo Sapiens
ccagggaggagggaaaagggaag

SEQ ID NO: 4184 - RNA, 22 nt, Homo Sapiens
ccagggagggaaaagauggaaa

SEQ ID NO: 4185 - RNA, 19 nt, Homo Sapiens
ccagggaggggagggggaa

SEQ ID NO: 4186 - RNA, 19 nt, Homo Sapiens
ccaggaacggaaauggaaa

SEQ ID NO: 4187 - RNA, 23 nt, Homo Sapiens
gccagcagagagcaaauggaaag

SEQ ID NO: 4188 - RNA, 22 nt, Homo Sapiens
gccagggagggagcaaggugga

SEQ ID NO: 4189 - RNA, 19 nt, Homo Sapiens
gccagggagggcuccaaau

SEQ ID NO: 4190 - RNA, 22 nt, Homo Sapiens
gccagggaggcaaaucgguaag

SEQ ID NO: 4191 - RNA, 19 nt, Homo Sapiens
gccagggagggcagcugga

SEQ ID NO: 4192 - RNA, 20 nt, Homo Sapiens
ggccagggaguggcaggugg

SEQ ID NO: 4193 - RNA, 20 nt, Homo Sapiens
ggccagggaggccaccugga

SEQ ID NO: 4194 - RNA, 20 nt, Homo Sapiens
gggcagggaggggaagggga

SEQ ID NO: 4195 - RNA, 21 nt, Homo Sapiens
ggccagggaggggguggaaag

SEQ ID NO: 4196 - RNA, 23 nt, Homo Sapiens
ggccagggaggggacagagagag

SEQ ID NO: 4197 - RNA, 22 nt, Homo Sapiens
uggccagggcccgggcagaagg

SEQ ID NO: 4198 - RNA, 24 nt, Homo Sapiens
uggcagggaggggcagcugggaag

SEQ ID NO: 4199 - RNA, 21 nt, Homo Sapiens
uggcacugagggcaaaaggaa

SEQ ID NO: 4200 - RNA, 24 nt, Homo Sapiens
uggaaagggagggcagagagaaag

SEQ ID NO: 4201 - RNA, 24 nt, Homo Sapiens
uggggagggagggcggugggaaag

SEQ ID NO: 4202 - RNA, 74 nt, Homo Sapiens
gccaauuagagguuaaauaaauugcuuaaaaguguucucaaaacuugcaguuucuucaaucuuaugaaauuggc

SEQ ID NO: 4203 - RNA, 24 nt, Homo Sapiens
uuagagguuaaauaaauugcuuaa

SEQ ID NO: 4204 - RNA, 22 nt, Homo Sapiens
agaggucucaaauaaauuuuaa

SEQ ID NO: 4205 - RNA, 23 nt, Homo Sapiens
agagguagcaaaauaaauuacuu

SEQ ID NO: 4206 - RNA, 20 nt, Homo Sapiens
agagguuaaguaagcugcuu

SEQ ID NO: 4207 - RNA, 20 nt, Homo Sapiens
agaugccaaauaaauugauu

SEQ ID NO: 4208 - RNA, 19 nt, Homo Sapiens
aguuugacaaucuuaugaa

SEQ ID NO: 4209 - RNA, 21 nt, Homo Sapiens
cagucuuuuuccaucuuauga

SEQ ID NO: 4210 - RNA, 19 nt, Homo Sapiens
caguuucuucuucaaucuu

SEQ ID NO: 4211 - RNA, 19 nt, Homo Sapiens
cauuuuguucaaucuugug

SEQ ID NO: 4212 - RNA, 21 nt, Homo Sapiens
gaggguaaaguauaaauugcu

SEQ ID NO: 4213 - RNA, 23 nt, Homo Sapiens
gcaguuucuucaaggugugugaa

SEQ ID NO: 4214 - RNA, 20 nt, Homo Sapiens
guuucuucagauucuucuga

SEQ ID NO: 4215 - RNA, 22 nt, Homo Sapiens
ugcaguuucccuucagucauga

SEQ ID NO: 4216 - RNA, 26 nt, Homo Sapiens
ugaauuugcuucacaugucuuaugaa

SEQ ID NO: 4217 - RNA, 19 nt, Homo Sapiens
ugcaguuuccucagauauu

SEQ ID NO: 4218 - RNA, 23 nt, Homo Sapiens
ugaaauuucuucaagucuuuuga

SEQ ID NO: 4219 - RNA, 20 nt, Homo Sapiens
ugcaguuucuuucucugaug

SEQ ID NO: 4220 - RNA, 21 nt, Homo Sapiens
uguacugucuucaauccuaug

SEQ ID NO: 4221 - RNA, 20 nt, Homo Sapiens
uuaggaaguuaaauaaguug

SEQ ID NO: 4222 - RNA, 21 nt, Homo Sapiens
uuaggagguuaaaaaaugcuu

SEQ ID NO: 4223 - RNA, 25 nt, Homo Sapiens
uuauagccuaaaauaaauuacauaa

SEQ ID NO: 4224 - RNA, 21 nt, Homo Sapiens
uuagagguuuuauuaguugcu

SEQ ID NO: 4225 - RNA, 22 nt, Homo Sapiens
uuaguaauaaaaaaaauugcuu

SEQ ID NO: 4226 - RNA, 22 nt, Homo Sapiens
uuagugauaaaauaaauuguuu

SEQ ID NO: 4227 - RNA, 23 nt, Homo Sapiens
uuaaauauuaaauaaauuauuua

SEQ ID NO: 4228 - RNA, 21 nt, Homo Sapiens
uuagauuuauaaauugcuuaa

SEQ ID NO: 4229 - RNA, 25 nt, Homo Sapiens
uugcaguuuucagcuuuaauuuuau

SEQ ID NO: 4230 - RNA, 24 nt, Homo Sapiens
uugcaguuuaccucaagccuuuau

SEQ ID NO: 4231 - RNA, 24 nt, Homo Sapiens
uugcagauucaaagucaaucuuau

SEQ ID NO: 4232 - RNA, 23 nt, Homo Sapiens
uuacaaauucuucaauuucuaug

SEQ ID NO: 4233 - RNA, 21 nt, Homo Sapiens
uugcaguuuccaaaccuugaa

SEQ ID NO: 4234 - RNA, 60 nt, Homo Sapiens
gccaccacucggguacggaggcucagagacuacuauagcagccggagucagagugguggc

SEQ ID NO: 4235 - RNA, 24 nt, Homo Sapiens
uagcagccggagucagaguggugg

SEQ ID NO: 4236 - RNA, 20 nt, Homo Sapiens
agacgacggccgaguggugg

SEQ ID NO: 4237 - RNA, 18 nt, Homo Sapiens
cagccggagcagcagcgg

SEQ ID NO: 4238 - RNA, 21 nt, Homo Sapiens
cagcuagaaucagaguggugg

SEQ ID NO: 4239 - RNA, 26 nt, Homo Sapiens
gcagccggagcagucagagcggcugg

SEQ ID NO: 4240 - RNA, 20 nt, Homo Sapiens
gcagccggaggcgcagcugg

SEQ ID NO: 4241 - RNA, 17 nt, Homo Sapiens
gcagccggaggaggggu

SEQ ID NO: 4242 - RNA, 21 nt, Homo Sapiens
gcagccggaugcagguggagg

SEQ ID NO: 4243 - RNA, 20 nt, Homo Sapiens
gcgggagcagagaguggugg

SEQ ID NO: 4244 - RNA, 24 nt, Homo Sapiens
uaacagaagggccaggaguggugg

SEQ ID NO: 4245 - RNA, 63 nt, Homo Sapiens
gccacccuacgccguagccguccagagacuggcaggccucggcuaaaggucuggagggugagc

SEQ ID NO: 4246 - RNA, 24 nt, Homo Sapiens
uggcaggccucggcuaaaggucug

SEQ ID NO: 4247 - RNA, 21 nt, Homo Sapiens
aggguuuggcuaaagggucug

SEQ ID NO: 4248 - RNA, 18 nt, Homo Sapiens
aggcccagcaaaggucug

SEQ ID NO: 4249 - RNA, 22 nt, Homo Sapiens
caggccucgguccaagccucug

SEQ ID NO: 4250 - RNA, 23 nt, Homo Sapiens
gcagcuccucuuggcuaaagguc

SEQ ID NO: 4251 - RNA, 19 nt, Homo Sapiens
gcaggccuccuggcucaag

SEQ ID NO: 4252 - RNA, 16 nt, Homo Sapiens
gcaggccuccgcaggu

SEQ ID NO: 4253 - RNA, 21 nt, Homo Sapiens
gcaggccucggccgaggugug

SEQ ID NO: 4254 - RNA, 20 nt, Homo Sapiens
gcagggcucagaaaggucug

SEQ ID NO: 4255 - RNA, 20 nt, Homo Sapiens
ggcaggccuggccagaaggu

SEQ ID NO: 4256 - RNA, 23 nt, Homo Sapiens
ggcaggccugugcaagaaggacu

SEQ ID NO: 4257 - RNA, 19 nt, Homo Sapiens
ggcaggccugggaugaggu

SEQ ID NO: 4258 - RNA, 21 nt, Homo Sapiens
ggcaggagggagcuaaagguc

SEQ ID NO: 4259 - RNA, 21 nt, Homo Sapiens
ggcaggggugaauaaaggucu

SEQ ID NO: 4260 - RNA, 19 nt, Homo Sapiens
uggcaggccuggcccacag

SEQ ID NO: 4261 - RNA, 72 nt, Homo Sapiens
gccagcaaagacugccucuucgccaucguggggaacaaaguggaccucacugaggagggggccuuggcgggc

SEQ ID NO: 4262 - RNA, 24 nt, Homo Sapiens
ucacugaggagggggccuuggcgg

SEQ ID NO: 4263 - RNA, 19 nt, Homo Sapiens
acuggggagggggccuugg

SEQ ID NO: 4264 - RNA, 26 nt, Homo Sapiens
cacagagccugagggaggccuuggcg

SEQ ID NO: 4265 - RNA, 23 nt, Homo Sapiens
cacagaggaggggccccugccgg

SEQ ID NO: 4266 - RNA, 22 nt, Homo Sapiens
cugacugaggcugccuuggcgg

SEQ ID NO: 4267 - RNA, 19 nt, Homo Sapiens
cuggggcagggggccuugg

SEQ ID NO: 4268 - RNA, 17 nt, Homo Sapiens
cuaaggagggggcuggc

SEQ ID NO: 4269 - RNA, 19 nt, Homo Sapiens
cugaggggggccuugccgg

SEQ ID NO: 4270 - RNA, 20 nt, Homo Sapiens
ucacugaggccagggagccu

SEQ ID NO: 4271 - RNA, 23 nt, Homo Sapiens
ucacucagggagaggggccuugg

SEQ ID NO: 4272 - RNA, 19 nt, Homo Sapiens
ucagggaggagggggcauu

SEQ ID NO: 4273 - RNA, 21 nt, Homo Sapiens
ucacagaggugggggccuugg

SEQ ID NO: 4274 - RNA, 21 nt, Homo Sapiens
ugagguaggggaggccuuggc

SEQ ID NO: 4275 - RNA, 18 nt, Homo Sapiens
ugaggagggggcuggugg

SEQ ID NO: 4276 - RNA, 62 nt, Homo Sapiens
gccaucacugccacccagaagacuguuggauggccccuccgggaaaacuguggcgugauggc

SEQ ID NO: 4277 - RNA, 24 nt, Homo Sapiens
ucacugccacccagaagacuguug

SEQ ID NO: 4278 - RNA, 20 nt, Homo Sapiens
acuugcaccagagacuguug

SEQ ID NO: 4279 - RNA, 20 nt, Homo Sapiens
cacuggggccacccagagga

SEQ ID NO: 4280 - RNA, 21 nt, Homo Sapiens
cacugccaccucugcagcugu

SEQ ID NO: 4281 - RNA, 24 nt, Homo Sapiens
cacugccacugagaacacugauug

SEQ ID NO: 4282 - RNA, 21 nt, Homo Sapiens
cucccacccagaacauucugu

SEQ ID NO: 4283 - RNA, 24 nt, Homo Sapiens
ucagcugcagugaaaagacuguug

SEQ ID NO: 4284 - RNA, 25 nt, Homo Sapiens
ucacugccaccuccaaugucugcug

SEQ ID NO: 4285 - RNA, 18 nt, Homo Sapiens
ucccucuacccagaagac

SEQ ID NO: 4286 - RNA, 20 nt, Homo Sapiens
ucacugccauccacaugucu

SEQ ID NO: 4287 - RNA, 22 nt, Homo Sapiens
ucacugccaccaacagcacugu

SEQ ID NO: 4288 - RNA, 21 nt, Homo Sapiens
ugccacccaacagaagauugu

SEQ ID NO: 4289 - RNA, 21 nt, Homo Sapiens
ugccacccaugagaacuggug

SEQ ID NO: 4290 - RNA, 74 nt, Homo Sapiens
gccauggcggccaugaguuguugcggcggguuucgguuacugcgguggcagcucugucuggccggccccuuggc

SEQ ID NO: 4291 - RNA, 24 nt, Homo Sapiens
uggcggccaugaguuguugcggcg

SEQ ID NO: 4292 - RNA, 19 nt, Homo Sapiens
gcggccaugaggcguugcg

SEQ ID NO: 4293 - RNA, 23 nt, Homo Sapiens
ggccaugaggggcuguugcagcg

SEQ ID NO: 4294 - RNA, 18 nt, Homo Sapiens
ggcggccacuuguugcgg

SEQ ID NO: 4295 - RNA, 20 nt, Homo Sapiens
ggcggccauagugcuugugg

SEQ ID NO: 4296 - RNA, 21 nt, Homo Sapiens
ggcggccauuugguguggggg

SEQ ID NO: 4297 - RNA, 19 nt, Homo Sapiens
ggcggcccgcuuguugcgg

SEQ ID NO: 4298 - RNA, 20 nt, Homo Sapiens
uggcggccagagccgcuugc

SEQ ID NO: 4299 - RNA, 20 nt, Homo Sapiens
ugguggagaccaguuguugc

SEQ ID NO: 4300 - RNA, 26 nt, Homo Sapiens
uggcggccaggaggucuggccaggcg

SEQ ID NO: 4301 - RNA, 77 nt, Homo Sapiens
gcccagcccauggcugccaugggaggccugaaggugcuucugcacugggcugguccaggcggcggggagcccugggu

SEQ ID NO: 4302 - RNA, 24 nt, Homo Sapiens
uggcugccaugggaggccugaagg

SEQ ID NO: 4303 - RNA, 21 nt, Homo Sapiens
ccauggggcggggccugaagg

SEQ ID NO: 4304 - RNA, 20 nt, Homo Sapiens
cugccauggggaagggcuga

SEQ ID NO: 4305 - RNA, 19 nt, Homo Sapiens
cugccauggaagcccaagg

SEQ ID NO: 4306 - RNA, 22 nt, Homo Sapiens
gcucgccauccugggaggccug

SEQ ID NO: 4307 - RNA, 26 nt, Homo Sapiens
gcugcacgcuugggggugccugaagg

SEQ ID NO: 4308 - RNA, 24 nt, Homo Sapiens
gcagccaugggaagugaccugaag

SEQ ID NO: 4309 - RNA, 19 nt, Homo Sapiens
gcagcccuuggaggccuga

SEQ ID NO: 4310 - RNA, 23 nt, Homo Sapiens
ggcugccauguggcccaggccug

SEQ ID NO: 4311 - RNA, 19 nt, Homo Sapiens
uggaagccaugggacggcc

SEQ ID NO: 4312 - RNA, 20 nt, Homo Sapiens
ugccugccaugggugagccu

SEQ ID NO: 4313 - RNA, 19 nt, Homo Sapiens
uggaucccuggaggccuga

SEQ ID NO: 4314 - RNA, 22 nt, Homo Sapiens
uggcagacacugaggccugaag

SEQ ID NO: 4315 - RNA, 24 nt, Homo Sapiens
uggcuaucaugggaggacugcagg

SEQ ID NO: 4316 - RNA, 24 nt, Homo Sapiens
uggcucugaucucaggccugaagg

SEQ ID NO: 4317 - RNA, 24 nt, Homo Sapiens
ugucuuccuucccaggccugaagg

SEQ ID NO: 4318 - RNA, 60 nt, Homo Sapiens
gccccaaccuccuggcuuggucuccgcuuguuguuggcuaccuaguuccagguugagggc

SEQ ID NO: 4319 - RNA, 22 nt, Homo Sapiens
uaccuaguuccagguugagggc

SEQ ID NO: 4320 - RNA, 16 nt, Homo Sapiens
accuggcagguugagg

SEQ ID NO: 4321 - RNA, 20 nt, Homo Sapiens
accuaacaccagguugaagg

SEQ ID NO: 4322 - RNA, 19 nt, Homo Sapiens
accuaguuccaguuccggg

SEQ ID NO: 4323 - RNA, 21 nt, Homo Sapiens
cuuguuccaggucuucugagg

SEQ ID NO: 4324 - RNA, 21 nt, Homo Sapiens
uaccuaguuauggugugaagg

SEQ ID NO: 4325 - RNA, 17 nt, Homo Sapiens
uaccuaguugguuaagg

SEQ ID NO: 4326 - RNA, 20 nt, Homo Sapiens
uagcucaucacguugagggc

SEQ ID NO: 4327 - RNA, 20 nt, Homo Sapiens
uagaucacaggguugagggc

SEQ ID NO: 4328 - RNA, 74 nt, Homo Sapiens
gccccgccccugccgccggaauccugaagcccaaggucugcccgggggcgguccggcggcgccggcgauggggc

SEQ ID NO: 4329 - RNA, 24 nt, Homo Sapiens
ugccgccggaauccugaagcccaa

SEQ ID NO: 4330 - RNA, 20 nt, Homo Sapiens
ccgugcauccugaagaucaa

SEQ ID NO: 4331 - RNA, 19 nt, Homo Sapiens
ccuccuggaauccugaugc

SEQ ID NO: 4332 - RNA, 24 nt, Homo Sapiens
gccagcgggcaccuccugaagccc

SEQ ID NO: 4333 - RNA, 25 nt, Homo Sapiens
gccgccggggacuuacugaagccca

SEQ ID NO: 4334 - RNA, 20 nt, Homo Sapiens
gcagccggucacugaagccc

SEQ ID NO: 4335 - RNA, 19 nt, Homo Sapiens
gccgccuccugaagcucca

SEQ ID NO: 4336 - RNA, 19 nt, Homo Sapiens
gccccgcagcccugaagcc

SEQ ID NO: 4337 - RNA, 19 nt, Homo Sapiens
gccguggguuccugaagcc

SEQ ID NO: 4338 - RNA, 18 nt, Homo Sapiens
gcggccggaaucgaggcc

SEQ ID NO: 4339 - RNA, 21 nt, Homo Sapiens
gccucccgcguccugaagccc

SEQ ID NO: 4340 - RNA, 21 nt, Homo Sapiens
gccccgggaggcugaagccca

SEQ ID NO: 4341 - RNA, 26 nt, Homo Sapiens
ugcagcucacaaucccaugaagccca

SEQ ID NO: 4342 - RNA, 19 nt, Homo Sapiens
ugccgccggcuccgaggcc

SEQ ID NO: 4343 - RNA, 19 nt, Homo Sapiens
ugcccccagccugaagccc

SEQ ID NO: 4344 - RNA, 73 nt, Homo Sapiens
gccccucaagucggguaugaaggagcuggccguguuccgggagaaggucacugagcagcaccggcagaugggc

SEQ ID NO: 4345 - RNA, 24 nt, Homo Sapiens
ucggguaugaaggagcuggccgug

SEQ ID NO: 4346 - RNA, 22 nt, Homo Sapiens
cgggcauggggaggagcuggcc

SEQ ID NO: 4347 - RNA, 17 nt, Homo Sapiens
cgggucucggagcuggc

SEQ ID NO: 4348 - RNA, 23 nt, Homo Sapiens
gggaaccaaggagcugagcccug

SEQ ID NO: 4349 - RNA, 20 nt, Homo Sapiens
gggcauuugggagcuggccg

SEQ ID NO: 4350 - RNA, 20 nt, Homo Sapiens
gggcauagaaccuggccgug

SEQ ID NO: 4351 - RNA, 20 nt, Homo Sapiens
gguaugaagaagcauagccg

SEQ ID NO: 4352 - RNA, 20 nt, Homo Sapiens
ucagggcugacggagcuggc

SEQ ID NO: 4353 - RNA, 74 nt, Homo Sapiens
gcccucccuuuggucucccuguucuucuauguggugacagauggcaaggaaguccuacuaccagagguuggggc

SEQ ID NO: 4354 - RNA, 24 nt, Homo Sapiens
uggcaaggaaguccuacuaccaga

SEQ ID NO: 4355 - RNA, 22 nt, Homo Sapiens
caaggaaguaaccauaguacca

SEQ ID NO: 4356 - RNA, 17 nt, Homo Sapiens
caaggaaguuucuacca

SEQ ID NO: 4357 - RNA, 19 nt, Homo Sapiens
gcauaugaaguccuaauac

SEQ ID NO: 4358 - RNA, 17 nt, Homo Sapiens
gcaaggaagcugccacc

SEQ ID NO: 4359 - RNA, 20 nt, Homo Sapiens
gcaaggaagucuuucuccag

SEQ ID NO: 4360 - RNA, 19 nt, Homo Sapiens
ggcaggaggaagucccacu

SEQ ID NO: 4361 - RNA, 24 nt, Homo Sapiens
ggaaagguccaaguccuacucaga

SEQ ID NO: 4362 - RNA, 23 nt, Homo Sapiens
gguaagguaaguuacuacuacca

SEQ ID NO: 4363 - RNA, 19 nt, Homo Sapiens
ggcaaggaagugcucuucc

SEQ ID NO: 4364 - RNA, 23 nt, Homo Sapiens
uggcaaggaacuuccuccucaga

SEQ ID NO: 4365 - RNA, 21 nt, Homo Sapiens
ugucaaggaagaguccuacua

SEQ ID NO: 4366 - RNA, 22 nt, Homo Sapiens
uggcaaaaggugauacuaccag

SEQ ID NO: 4367 - RNA, 23 nt, Homo Sapiens
uggguaggaaguccugcugccag

SEQ ID NO: 4368 - RNA, 23 nt, Homo Sapiens
uggcaaggaacucuauugccaga

SEQ ID NO: 4369 - RNA, 86 nt, Homo Sapiens
gcccucgcccggccugucagcgcugcucuccgccgcagcuucagcaccucggcccagaacaaugcuaaaguagcugugcuaggggc

SEQ ID NO: 4370 - RNA, 24 nt, Homo Sapiens
ugucagcgcugcucuccgccgcag

SEQ ID NO: 4371 - RNA, 20 nt, Homo Sapiens
cagcgcugccucccccugca

SEQ ID NO: 4372 - RNA, 19 nt, Homo Sapiens
cagcgcugcccccucccgc

SEQ ID NO: 4373 - RNA, 19 nt, Homo Sapiens
cagcgcugcuguuggcggc

SEQ ID NO: 4374 - RNA, 21 nt, Homo Sapiens
ugccugcagcugcucucugcc

SEQ ID NO: 4375 - RNA, 21 nt, Homo Sapiens
uggcaguggcugcucucggcc

SEQ ID NO: 4376 - RNA, 19 nt, Homo Sapiens
ugccagccugcucuccccc

SEQ ID NO: 4377 - RNA, 21 nt, Homo Sapiens
ugccggcgcugcuccugccgc

SEQ ID NO: 4378 - RNA, 65 nt, Homo Sapiens
gccgcaucuucuuuugcgucgccagccgagccacaucgcucagacaccauggggaaggugaaggu

SEQ ID NO: 4379 - RNA, 24 nt, Homo Sapiens
cgcucagacaccauggggaaggug

SEQ ID NO: 4380 - RNA, 19 nt, Homo Sapiens
agacaccauggcugaaagu

SEQ ID NO: 4381 - RNA, 19 nt, Homo Sapiens
agacaccauguggcaagug

SEQ ID NO: 4382 - RNA, 18 nt, Homo Sapiens
agucuccaugggaaggug

SEQ ID NO: 4383 - RNA, 25 nt, Homo Sapiens
cagagcucaccaugggcugcaggug

SEQ ID NO: 4384 - RNA, 19 nt, Homo Sapiens
cagacaccaucagugaagg

SEQ ID NO: 4385 - RNA, 18 nt, Homo Sapiens
cagacaccaggugauggu

SEQ ID NO: 4386 - RNA, 20 nt, Homo Sapiens
cgcucagacagcacugggga

SEQ ID NO: 4387 - RNA, 20 nt, Homo Sapiens
cgcucagggccauggggaag

SEQ ID NO: 4388 - RNA, 22 nt, Homo Sapiens
cgcucagacucugaggauguug

SEQ ID NO: 4389 - RNA, 21 nt, Homo Sapiens
cgcuccgagcccgggaaggug

SEQ ID NO: 4390 - RNA, 22 nt, Homo Sapiens
cucaaacagcucgcauggggaa

SEQ ID NO: 4391 - RNA, 20 nt, Homo Sapiens
cucaauaccaguggggaagg

SEQ ID NO: 4392 - RNA, 20 nt, Homo Sapiens
cucagacaccuuaggcaagg

SEQ ID NO: 4393 - RNA, 20 nt, Homo Sapiens
cucuuaaacccuggggaagg

SEQ ID NO: 4394 - RNA, 18 nt, Homo Sapiens
cucaaacacggggaaggu

SEQ ID NO: 4395 - RNA, 20 nt, Homo Sapiens
cucagacaccaggcguggug

SEQ ID NO: 4396 - RNA, 17 nt, Homo Sapiens
gcucagacaaggggaag

SEQ ID NO: 4397 - RNA, 19 nt, Homo Sapiens
gcucagacaauuggaaggu

SEQ ID NO: 4398 - RNA, 17 nt, Homo Sapiens
ucagacaccagggaggg

SEQ ID NO: 4399 - RNA, 20 nt, Homo Sapiens
ucaguaccauggggauggug

SEQ ID NO: 4400 - RNA, 60 nt, Homo Sapiens
gcgccgccuccuugaaacuuagcgcucugacccagagucugaccaggguacggcaggcgc

SEQ ID NO: 4401 - RNA, 24 nt, Homo Sapiens
gucugaccaggguacggcaggcgc

SEQ ID NO: 4402 - RNA, 17 nt, Homo Sapiens
acccgggaggcaggcgc

SEQ ID NO: 4403 - RNA, 22 nt, Homo Sapiens
agccugaccaggacgcauggca

SEQ ID NO: 4404 - RNA, 22 nt, Homo Sapiens
aggcugaccaggaguggggagg

SEQ ID NO: 4405 - RNA, 20 nt, Homo Sapiens
aggcggaccagggugggagg

SEQ ID NO: 4406 - RNA, 22 nt, Homo Sapiens
aggcugaccaggggaaggcagg

SEQ ID NO: 4407 - RNA, 21 nt, Homo Sapiens
agucugaccuaggucugcggg

SEQ ID NO: 4408 - RNA, 20 nt, Homo Sapiens
ccaggcgugcuggcaggcgc

SEQ ID NO: 4409 - RNA, 24 nt, Homo Sapiens
cugaggccggcgggcggcaggcgc

SEQ ID NO: 4410 - RNA, 22 nt, Homo Sapiens
cugaccagggaaccugccggcg

SEQ ID NO: 4411 - RNA, 19 nt, Homo Sapiens
cugaccagggaauuccagg

SEQ ID NO: 4412 - RNA, 19 nt, Homo Sapiens
cugaccaggggaaggcagg

SEQ ID NO: 4413 - RNA, 19 nt, Homo Sapiens
cugaccagggcccgcuggc

SEQ ID NO: 4414 - RNA, 20 nt, Homo Sapiens
cugaccagguaaugccaagc

SEQ ID NO: 4415 - RNA, 22 nt, Homo Sapiens
cugaccagggaauuccaggugc

SEQ ID NO: 4416 - RNA, 23 nt, Homo Sapiens
gaccaggguccaagagcaggugc

SEQ ID NO: 4417 - RNA, 19 nt, Homo Sapiens
gaccaggguuaguugcagg

SEQ ID NO: 4418 - RNA, 20 nt, Homo Sapiens
gaacagauucaggcaggcgc

SEQ ID NO: 4419 - RNA, 18 nt, Homo Sapiens
gaccagggugggaggggc

SEQ ID NO: 4420 - RNA, 18 nt, Homo Sapiens
gagcagggaggcaggcgc

SEQ ID NO: 4421 - RNA, 20 nt, Homo Sapiens
guuucaccauaggcaggcgc

SEQ ID NO: 4422 - RNA, 20 nt, Homo Sapiens
ucugaccagguuugcagcag

SEQ ID NO: 4423 - RNA, 19 nt, Homo Sapiens
ucugccaggguaccacagg

SEQ ID NO: 4424 - RNA, 20 nt, Homo Sapiens
ucugaccaggcaccagcagg

SEQ ID NO: 4425 - RNA, 20 nt, Homo Sapiens
ucuggccaggguacaggagg

SEQ ID NO: 4426 - RNA, 21 nt, Homo Sapiens
ugaccagggcuugcuccaggc

SEQ ID NO: 4427 - RNA, 20 nt, Homo Sapiens
ugagcaggguacggcggugc

SEQ ID NO: 4428 - RNA, 21 nt, Homo Sapiens
ugcccagcggagggcaggcgc

SEQ ID NO: 4429 - RNA, 64 nt, Homo Sapiens
gcgcucacuugucuucaggaagcucggagccuuugguggagccggggagaggaagggugggugc

SEQ ID NO: 4430 - RNA, 24 nt, Homo Sapiens
ucacuugucuucaggaagcucgga

SEQ ID NO: 4431 - RNA, 20 nt, Homo Sapiens
acaugucuucagccaagcuc

SEQ ID NO: 4432 - RNA, 18 nt, Homo Sapiens
acuggucuucaggggcuc

SEQ ID NO: 4433 - RNA, 20 nt, Homo Sapiens
cacuuucucugaggaagcuc

SEQ ID NO: 4434 - RNA, 23 nt, Homo Sapiens
cacuugucuugcagugggagcuc

SEQ ID NO: 4435 - RNA, 20 nt, Homo Sapiens
cacuugucuuacugguagcu

SEQ ID NO: 4436 - RNA, 21 nt, Homo Sapiens
caccugcuucaggaagcuggg

SEQ ID NO: 4437 - RNA, 21 nt, Homo Sapiens
cacugucuucaggaaacuggg

SEQ ID NO: 4438 - RNA, 22 nt, Homo Sapiens
cuugguccccaggaagcucuga

SEQ ID NO: 4439 - RNA, 21 nt, Homo Sapiens
cucgucguccggaagcuucgg

SEQ ID NO: 4440 - RNA, 24 nt, Homo Sapiens
ucacuugucacuagauggaagcuc

SEQ ID NO: 4441 - RNA, 21 nt, Homo Sapiens
ucacauguccucuucaggaag

SEQ ID NO: 4442 - RNA, 24 nt, Homo Sapiens
ucacuugucucucauuaagauagg

SEQ ID NO: 4443 - RNA, 23 nt, Homo Sapiens
ucauugucuucagguucaaguuc

SEQ ID NO: 4444 - RNA, 21 nt, Homo Sapiens
ugucuuccaacuaagcucgga

SEQ ID NO: 4445 - RNA, 20 nt, Homo Sapiens
uguccucaggaagcuccgga

SEQ ID NO: 4446 - RNA, 19 nt, Homo Sapiens
uggcugcaggaagcuggga

SEQ ID NO: 4447 - RNA, 22 nt, Homo Sapiens
uugucuucacuaagaagcuagg

SEQ ID NO: 4448 - RNA, 18 nt, Homo Sapiens
uugucuucaaaucuggga

SEQ ID NO: 4449 - RNA, 80 nt, Homo Sapiens
gcgggagcugggggugugccuccaggagcugcugauggcugacgggcggcccgggacugguggaucucccggcugaccgu

SEQ ID NO: 4450 - RNA, 24 nt, Homo Sapiens
ugggggugugccuccaggagcugc

SEQ ID NO: 4451 - RNA, 25 nt, Homo Sapiens
gggcgcgucccucuggaggagcugc

SEQ ID NO: 4452 - RNA, 21 nt, Homo Sapiens
gggccucugcguccaggagcu

SEQ ID NO: 4453 - RNA, 22 nt, Homo Sapiens
ggggugcggggcuaggagcugc

SEQ ID NO: 4454 - RNA, 19 nt, Homo Sapiens
gggaguccccaggagcugc

SEQ ID NO: 4455 - RNA, 19 nt, Homo Sapiens
ggagugcgggcaggagcug

SEQ ID NO: 4456 - RNA, 20 nt, Homo Sapiens
uggggguguccugucagaag

SEQ ID NO: 4457 - RNA, 23 nt, Homo Sapiens
uggggguguccuucccuggcugc

SEQ ID NO: 4458 - RNA, 69 nt, Homo Sapiens
gcgggcagccacaguuaccaagaagacuuaugagaucuggcaucgacggcaugacuacuggcugcuagc

SEQ ID NO: 4459 - RNA, 24 nt, Homo Sapiens
uggcaucgacggcaugacuacugg

SEQ ID NO: 4460 - RNA, 19 nt, Homo Sapiens
gcuucugaggcaugacuac

SEQ ID NO: 4461 - RNA, 21 nt, Homo Sapiens
uggcauccacaagacuacugg

SEQ ID NO: 4462 - RNA, 66 nt, Homo Sapiens
gcggggcccgggcggcggcgcuagcagauccagcggauaaaagcggucgaagaagccggguugcgc

SEQ ID NO: 4463 - RNA, 24 nt, Homo Sapiens
uaaaagcggucgaagaagccgggu

SEQ ID NO: 4464 - RNA, 18 nt, Homo Sapiens
aaaagcaugaagaagccg

SEQ ID NO: 4465 - RNA, 21 nt, Homo Sapiens
aagcaggucgaagauccccgg

SEQ ID NO: 4466 - RNA, 20 nt, Homo Sapiens
aagcggucgggguggccagg

SEQ ID NO: 4467 - RNA, 20 nt, Homo Sapiens
gcggucgaacaggagccggg

SEQ ID NO: 4468 - RNA, 18 nt, Homo Sapiens
uaaaugggugaagaagcc

SEQ ID NO: 4469 - RNA, 20 nt, Homo Sapiens
uaaaagcagcaaagccgggu

SEQ ID NO: 4470 - RNA, 24 nt, Homo Sapiens
uaaaagcgguagagcaggccgggu

SEQ ID NO: 4471 - RNA, 23 nt, Homo Sapiens
uacaagggguggggaagccgggu

SEQ ID NO: 4472 - RNA, 21 nt, Homo Sapiens
uauaaccagucgaagccgggu

SEQ ID NO: 4473 - RNA, 91 nt, Homo Sapiens
gcgguaaugaucagagaccgaggcugcaccggcagaggcugcggggcggacgcgcgggccggcgcagccauggugaagauuagcuuccagc

SEQ ID NO: 4474 - RNA, 24 nt, Homo Sapiens
ucagagaccgaggcugcaccggca

SEQ ID NO: 4475 - RNA, 20 nt, Homo Sapiens
agaggcagaggcugcagcgg

SEQ ID NO: 4476 - RNA, 27 nt, Homo Sapiens
cagcaggcagaggccugugcaccggca

SEQ ID NO: 4477 - RNA, 21 nt, Homo Sapiens
cagacggccgaggcugagccg

SEQ ID NO: 4478 - RNA, 28 nt, Homo Sapiens
cagaggggacaggggcugggcaccggca

SEQ ID NO: 4479 - RNA, 22 nt, Homo Sapiens
cagagaccgccacaugcugcac

SEQ ID NO: 4480 - RNA, 20 nt, Homo Sapiens
cagagaccguaugggcugca

SEQ ID NO: 4481 - RNA, 20 nt, Homo Sapiens
cagggauaggggcugcaccg

SEQ ID NO: 4482 - RNA, 20 nt, Homo Sapiens
cagagaccgagcggcacggg

SEQ ID NO: 4483 - RNA, 23 nt, Homo Sapiens
cacagagcaaggcugcacagcca

SEQ ID NO: 4484 - RNA, 23 nt, Homo Sapiens
ucagauaccgucggggcugcacc

SEQ ID NO: 4485 - RNA, 20 nt, Homo Sapiens
ucacagaccgaggcgcugca

SEQ ID NO: 4486 - RNA, 18 nt, Homo Sapiens
ucagagaccagcugcacc

SEQ ID NO: 4487 - RNA, 20 nt, Homo Sapiens
ucagagaccaggcaccaucg

SEQ ID NO: 4488 - RNA, 78 nt, Homo Sapiens
gcguuuuuugaaguuauugagauucuacauugcauugacugggauuccaguagcaauuuucauaacucuggugaaugu

SEQ ID NO: 4489 - RNA, 24 nt, Homo Sapiens
agcaauuuucauaacucuggugaa

SEQ ID NO: 4490 - RNA, 26 nt, Homo Sapiens
aauuucucaauuccaacucuggugaa

SEQ ID NO: 4491 - RNA, 20 nt, Homo Sapiens
agcaucacuuuuaacucugg

SEQ ID NO: 4492 - RNA, 23 nt, Homo Sapiens
agcauauuuucauauaccuguug

SEQ ID NO: 4493 - RNA, 24 nt, Homo Sapiens
agcaauuuuucauguccucuguug

SEQ ID NO: 4494 - RNA, 19 nt, Homo Sapiens
agcaauuuugcucagucug

SEQ ID NO: 4495 - RNA, 19 nt, Homo Sapiens
agcaauuuugauccuuugg

SEQ ID NO: 4496 - RNA, 20 nt, Homo Sapiens
agcuauuucauacucuggug

SEQ ID NO: 4497 - RNA, 22 nt, Homo Sapiens
agcaauuuuuagaacugcugaa

SEQ ID NO: 4498 - RNA, 18 nt, Homo Sapiens
auuuucauaucaggugaa

SEQ ID NO: 4499 - RNA, 18 nt, Homo Sapiens
auuuucauauccagugaa

SEQ ID NO: 4500 - RNA, 20 nt, Homo Sapiens
auuuuuaaaacucuggugaa

SEQ ID NO: 4501 - RNA, 19 nt, Homo Sapiens
caauuuucacuuuaacucu

SEQ ID NO: 4502 - RNA, 19 nt, Homo Sapiens
caauuuuuaaauaacucug

SEQ ID NO: 4503 - RNA, 20 nt, Homo Sapiens
caauuuucaacaaacaggug

SEQ ID NO: 4504 - RNA, 20 nt, Homo Sapiens
gcauauuuucauaaguccgg

SEQ ID NO: 4505 - RNA, 20 nt, Homo Sapiens
gcauauuuucauauaucugg

SEQ ID NO: 4506 - RNA, 19 nt, Homo Sapiens
uucauaacucagcugugaa

SEQ ID NO: 4507 - RNA, 16 nt, Homo Sapiens
uuuccauucuggugaa

SEQ ID NO: 4508 - RNA, 77 nt, Homo Sapiens
gcuauggcggauaugauuauacuggguauaacuaugggaacuauggauauggacagggauaugcagacuacaguggc

SEQ ID NO: 4509 - RNA, 24 nt, Homo Sapiens
uaugauuauacuggguauaacuau

SEQ ID NO: 4510 - RNA, 16 nt, Homo Sapiens
augguuaggguauaac

SEQ ID NO: 4511 - RNA, 22 nt, Homo Sapiens
auguuauagucaauauaacuau

SEQ ID NO: 4512 - RNA, 20 nt, Homo Sapiens
auuauacugagguauuauua

SEQ ID NO: 4513 - RNA, 21 nt, Homo Sapiens
uauguucuuuucuggguauaa

SEQ ID NO: 4514 - RNA, 24 nt, Homo Sapiens
uaugauuaucagucugaauaagua

SEQ ID NO: 4515 - RNA, 22 nt, Homo Sapiens
uaugauuauucuagagucauaa

SEQ ID NO: 4516 - RNA, 19 nt, Homo Sapiens
uaugauuauacuuguuuaa

SEQ ID NO: 4517 - RNA, 18 nt, Homo Sapiens
uaugauuauugguaaacu

SEQ ID NO: 4518 - RNA, 19 nt, Homo Sapiens
ugaguuauaccuggguaua

SEQ ID NO: 4519 - RNA, 20 nt, Homo Sapiens
ugaguauacugggacuaucu

SEQ ID NO: 4520 - RNA, 20 nt, Homo Sapiens
ugauuauacuacagauaacu

SEQ ID NO: 4521 - RNA, 67 nt, Homo Sapiens
gcuauuccaagaacaugaauggaggaauguugggccgaauuacagcgugguugugcaugggaguggu

SEQ ID NO: 4522 - RNA, 24 nt, Homo Sapiens
uuccaagaacaugaauggaggaau

SEQ ID NO: 4523 - RNA, 22 nt, Homo Sapiens
aagaacaugaugaugagagaaa

SEQ ID NO: 4524 - RNA, 19 nt, Homo Sapiens
aaguacaugaauggaggaa

SEQ ID NO: 4525 - RNA, 19 nt, Homo Sapiens
agaauccugaauggagaaa

SEQ ID NO: 4526 - RNA, 22 nt, Homo Sapiens
caaaauacaugaaugcaggaau

SEQ ID NO: 4527 - RNA, 22 nt, Homo Sapiens
caauaacaggaaaaauggagga

SEQ ID NO: 4528 - RNA, 19 nt, Homo Sapiens
caacaacagcaauggagga

SEQ ID NO: 4529 - RNA, 21 nt, Homo Sapiens
caagaacaugauuugaaaaau

SEQ ID NO: 4530 - RNA, 19 nt, Homo Sapiens
caggaaccuauggaggaau

SEQ ID NO: 4531 - RNA, 23 nt, Homo Sapiens
ccaagaacauucauaugaugaau

SEQ ID NO: 4532 - RNA, 19 nt, Homo Sapiens
ccaagaacauguuugugag

SEQ ID NO: 4533 - RNA, 20 nt, Homo Sapiens
ccaugcauaugaauggauga

SEQ ID NO: 4534 - RNA, 19 nt, Homo Sapiens
uccaagaacaagggagcaa

SEQ ID NO: 4535 - RNA, 22 nt, Homo Sapiens
uccccgcacaucaauggaggaa

SEQ ID NO: 4536 - RNA, 25 nt, Homo Sapiens
uugcauagauacagaguggaggaau

SEQ ID NO: 4537 - RNA, 21 nt, Homo Sapiens
uuucaagagaacacaugaaug

SEQ ID NO: 4538 - RNA, 19 nt, Homo Sapiens
uuccaagaauagugauaug

SEQ ID NO: 4539 - RNA, 24 nt, Homo Sapiens
uuccaagaaccuuagaaguuggag

SEQ ID NO: 4540 - RNA, 23 nt, Homo Sapiens
uuucaagccauggaauggaggaa

SEQ ID NO: 4541 - RNA, 18 nt, Homo Sapiens
uuccaagaacagaggagg

SEQ ID NO: 4542 - RNA, 18 nt, Homo Sapiens
uuccaagaacaagagagg

SEQ ID NO: 4543 - RNA, 18 nt, Homo Sapiens
uucccagaagaauggagg

SEQ ID NO: 4544 - RNA, 80 nt, Homo Sapiens
gcuccgccuuuucuggguacuuacgguccugagucucaaguucgucuucgagaugcuguugugccagaagcuggcggagc

SEQ ID NO: 4545 - RNA, 24 nt, Homo Sapiens
ucuggguacuuacgguccugaguc

SEQ ID NO: 4546 - RNA, 24 nt, Homo Sapiens
ggguaugucacaggcuccugaguc

SEQ ID NO: 4547 - RNA, 19 nt, Homo Sapiens
ggauaaucccgguccugag

SEQ ID NO: 4548 - RNA, 24 nt, Homo Sapiens
ucuggguacaauuaauguuucuga

SEQ ID NO: 4549 - RNA, 21 nt, Homo Sapiens
ucuggguaccugccguccaga

SEQ ID NO: 4550 - RNA, 21 nt, Homo Sapiens
ucaggaugcuacgguccugag

SEQ ID NO: 4551 - RNA, 19 nt, Homo Sapiens
ucuggguuuggguccugag

SEQ ID NO: 4552 - RNA, 22 nt, Homo Sapiens
ucuggguacuaaagucauaagu

SEQ ID NO: 4553 - RNA, 23 nt, Homo Sapiens
ucuggguacagacuguccuaguc

SEQ ID NO: 4554 - RNA, 18 nt, Homo Sapiens
ugggcacuggguccugag

SEQ ID NO: 4555 - RNA, 20 nt, Homo Sapiens
uggguggggaggguccugag

SEQ ID NO: 4556 - RNA, 60 nt, Homo Sapiens
gcugacauuaacuacaauuaugggaaaugcaaaagcuguuuggauaugguaguguguggu

SEQ ID NO: 4557 - RNA, 24 nt, Homo Sapiens
ugacauuaacuacaauuaugggaa

SEQ ID NO: 4558 - RNA, 20 nt, Homo Sapiens
acauguaacuacaaacuuau

SEQ ID NO: 4559 - RNA, 23 nt, Homo Sapiens
acaauacauacaauuaucaggaa

SEQ ID NO: 4560 - RNA, 20 nt, Homo Sapiens
acauacuacaauucaggaaa

SEQ ID NO: 4561 - RNA, 23 nt, Homo Sapiens
  misc_feature (18)..(18): n is a, c, g or u
auuaacuacaaaauguunuggga

SEQ ID NO: 4562 - RNA, 21 nt, Homo Sapiens
aucaacuacaauguaauugga

SEQ ID NO: 4563 - RNA, 18 nt, Homo Sapiens
auuuaauaaauuauggga

SEQ ID NO: 4564 - RNA, 21 nt, Homo Sapiens
caauuacuacaauuauagaaa

SEQ ID NO: 4565 - RNA, 20 nt, Homo Sapiens
caugaagaaaauuaugggaa

SEQ ID NO: 4566 - RNA, 23 nt, Homo Sapiens
gacuuugacucuucaauuauggg

SEQ ID NO: 4567 - RNA, 22 nt, Homo Sapiens
gacauuaacuauaauaauaugg

SEQ ID NO: 4568 - RNA, 19 nt, Homo Sapiens
gacaagaacuacaauuugg

SEQ ID NO: 4569 - RNA, 21 nt, Homo Sapiens
gaaauuuauuucaauuauggg

SEQ ID NO: 4570 - RNA, 26 nt, Homo Sapiens
ugacaguaugccacuauaauuauggg

SEQ ID NO: 4571 - RNA, 19 nt, Homo Sapiens
ugacauuaauccacaauua

SEQ ID NO: 4572 - RNA, 18 nt, Homo Sapiens
ugacacguauacaauuau

SEQ ID NO: 4573 - RNA, 19 nt, Homo Sapiens
ugacauuaaaaacuaauau

SEQ ID NO: 4574 - RNA, 18 nt, Homo Sapiens
ugacauuaacauaauuau

SEQ ID NO: 4575 - RNA, 18 nt, Homo Sapiens
ugacauuaagaacuuaug

SEQ ID NO: 4576 - RNA, 24 nt, Homo Sapiens
ugacauuaacaagccuaaugggaa

SEQ ID NO: 4577 - RNA, 22 nt, Homo Sapiens
uggcuuuauacaauuauagcaa

SEQ ID NO: 4578 - RNA, 65 nt, Homo Sapiens
gcugaccaugcagcaacugaacuggcucuguaccaucagagccuuucccggcgaucuggcucagc

SEQ ID NO: 4579 - RNA, 24 nt, Homo Sapiens
ugaccaugcagcaacugaacuggc

SEQ ID NO: 4580 - RNA, 21 nt, Homo Sapiens
acaaugacaaaacugaacugg

SEQ ID NO: 4581 - RNA, 23 nt, Homo Sapiens
acaacgcaacacaccugaacugg

SEQ ID NO: 4582 - RNA, 18 nt, Homo Sapiens
caugcaacacugaacugg

SEQ ID NO: 4583 - RNA, 20 nt, Homo Sapiens
caugacccaacugaacuggc

SEQ ID NO: 4584 - RNA, 21 nt, Homo Sapiens
ccaugcagcacugcccuaggc

SEQ ID NO: 4585 - RNA, 18 nt, Homo Sapiens
cccuacagacugaacugg

SEQ ID NO: 4586 - RNA, 19 nt, Homo Sapiens
ugacccaagagcaacugaa

SEQ ID NO: 4587 - RNA, 23 nt, Homo Sapiens
ugaccaugccggcacccugaucu

SEQ ID NO: 4588 - RNA, 19 nt, Homo Sapiens
ugaccacagagcaacugaa

SEQ ID NO: 4589 - RNA, 25 nt, Homo Sapiens
uggccugaagcaacugaagaucugg

SEQ ID NO: 4590 - RNA, 23 nt, Homo Sapiens
uguccaugcagcuccuacucggc

SEQ ID NO: 4591 - RNA, 73 nt, Homo Sapiens
gcugacgccggcuagggaggagcagcccccacaacaucgauccaagagggggagcucagugggcggcgugugc

SEQ ID NO: 4592 - RNA, 24 nt, Homo Sapiens
ugacgccggcuagggaggagcagc

SEQ ID NO: 4593 - RNA, 20 nt, Homo Sapiens
acgggggcagggaggagcag

SEQ ID NO: 4594 - RNA, 19 nt, Homo Sapiens
ccggcuccaggaggagcag

SEQ ID NO: 4595 - RNA, 20 nt, Homo Sapiens
cgccgcugccggggaggagc

SEQ ID NO: 4596 - RNA, 22 nt, Homo Sapiens
cggcggcaggaggaggagcagc

SEQ ID NO: 4597 - RNA, 22 nt, Homo Sapiens
cgccggcucggcggggaggagc

SEQ ID NO: 4598 - RNA, 23 nt, Homo Sapiens
cgccgcugggugacaggagcagc

SEQ ID NO: 4599 - RNA, 19 nt, Homo Sapiens
cgcaggccgcaggagcagc

SEQ ID NO: 4600 - RNA, 19 nt, Homo Sapiens
cggcggcggcaggagcagc

SEQ ID NO: 4601 - RNA, 22 nt, Homo Sapiens
gacagcgggcauggggaggagc

SEQ ID NO: 4602 - RNA, 25 nt, Homo Sapiens
gaagccuggaucuagggaggggcag

SEQ ID NO: 4603 - RNA, 22 nt, Homo Sapiens
gacgccggcggcaugaagcagc

SEQ ID NO: 4604 - RNA, 23 nt, Homo Sapiens
gaggacgguagggaggauugcag

SEQ ID NO: 4605 - RNA, 21 nt, Homo Sapiens
gacccaggagggaggaggcag

SEQ ID NO: 4606 - RNA, 18 nt, Homo Sapiens
gacgccggcggggcgagc

SEQ ID NO: 4607 - RNA, 18 nt, Homo Sapiens
gcaggccaggaggagcag

SEQ ID NO: 4608 - RNA, 20 nt, Homo Sapiens
gccagauacggaggagcagc

SEQ ID NO: 4609 - RNA, 18 nt, Homo Sapiens
gccggcuaggagggcggc

SEQ ID NO: 4610 - RNA, 21 nt, Homo Sapiens
ugacuuggcggguagggagga

SEQ ID NO: 4611 - RNA, 25 nt, Homo Sapiens
ugacgccgggcagcgcguggagcag

SEQ ID NO: 4612 - RNA, 25 nt, Homo Sapiens
uggcgccugcuagggaggcaggcag

SEQ ID NO: 4613 - RNA, 19 nt, Homo Sapiens
ugacgccggccgcgcagga

SEQ ID NO: 4614 - RNA, 18 nt, Homo Sapiens
ugaggcagagggaggagc

SEQ ID NO: 4615 - RNA, 23 nt, Homo Sapiens
ugaggcaggacagagaggagcag

SEQ ID NO: 4616 - RNA, 20 nt, Homo Sapiens
ugagcccugggaggagcagc

SEQ ID NO: 4617 - RNA, 22 nt, Homo Sapiens
ugccucgggcgggaggagccgc

SEQ ID NO: 4618 - RNA, 66 nt, Homo Sapiens
gcugacgugggugugaucgcuagcagcuucgagaucgggaaccuggcgcucauccucuucgugagc

SEQ ID NO: 4619 - RNA, 24 nt, Homo Sapiens
ugacgugggugugaucgcuagcag

SEQ ID NO: 4620 - RNA, 25 nt, Homo Sapiens
accugggaauuugaagcgcuagcag

SEQ ID NO: 4621 - RNA, 21 nt, Homo Sapiens
cgugggugugaucccaaccag

SEQ ID NO: 4622 - RNA, 25 nt, Homo Sapiens
gacguggguagauaaucgcaugcag

SEQ ID NO: 4623 - RNA, 24 nt, Homo Sapiens
gacugggugugaaucaugcagcag

SEQ ID NO: 4624 - RNA, 18 nt, Homo Sapiens
guggguguguggcugcag

SEQ ID NO: 4625 - RNA, 26 nt, Homo Sapiens
ugagugggugugcggaugcucagcag

SEQ ID NO: 4626 - RNA, 21 nt, Homo Sapiens
ugacgugggcguggugucgcu

SEQ ID NO: 4627 - RNA, 70 nt, Homo Sapiens
gcugagaagcagugacccgcagaugccggcugaauggacugcuccggucuuggagucacugcuacucagc

SEQ ID NO: 4628 - RNA, 24 nt, Homo Sapiens
ugagaagcagugacccgcagaugc

SEQ ID NO: 4629 - RNA, 22 nt, Homo Sapiens
aagcagugacacuccguaguug

SEQ ID NO: 4630 - RNA, 19 nt, Homo Sapiens
aagcagugaaccaugcaga

SEQ ID NO: 4631 - RNA, 19 nt, Homo Sapiens
aagagugacccgccgaggc

SEQ ID NO: 4632 - RNA, 18 nt, Homo Sapiens
aaucaggacccgcagugc

SEQ ID NO: 4633 - RNA, 22 nt, Homo Sapiens
agaaugaaggaagccgcagaug

SEQ ID NO: 4634 - RNA, 16 nt, Homo Sapiens
agaagccccgcagaug

SEQ ID NO: 4635 - RNA, 19 nt, Homo Sapiens
agaagcagugaccaggaug

SEQ ID NO: 4636 - RNA, 19 nt, Homo Sapiens
agcagagccacgcagaugc

SEQ ID NO: 4637 - RNA, 18 nt, Homo Sapiens
gaagcgucucgcagaugc

SEQ ID NO: 4638 - RNA, 24 nt, Homo Sapiens
gagaagcagcuccuuaccccagau

SEQ ID NO: 4639 - RNA, 21 nt, Homo Sapiens
gagaagcaguguucaggcaga

SEQ ID NO: 4640 - RNA, 25 nt, Homo Sapiens
gagaagcaggggccccuccagacgc

SEQ ID NO: 4641 - RNA, 19 nt, Homo Sapiens
gagaagcagggggcugcag

SEQ ID NO: 4642 - RNA, 21 nt, Homo Sapiens
gagaagcagccaaaugcagau

SEQ ID NO: 4643 - RNA, 21 nt, Homo Sapiens
ugaugacagcagugaccacgc

SEQ ID NO: 4644 - RNA, 26 nt, Homo Sapiens
ugagaagcagcccccacacagcaugc

SEQ ID NO: 4645 - RNA, 19 nt, Homo Sapiens
ugggcagcagugacccuca

SEQ ID NO: 4646 - RNA, 24 nt, Homo Sapiens
ugggaaucccggacccgcagcugc

SEQ ID NO: 4647 - RNA, 74 nt, Homo Sapiens
gcugcaucaaagguagacuuucgcacagguugugagguuggagucacaguguuauuuguuguaccugauguagu

SEQ ID NO: 4648 - RNA, 74 nt, Homo Sapiens; identical to SEQ ID NO: 4647

SEQ ID NO: 4649 - RNA, 74 nt, Homo Sapiens; identical to SEQ ID NO: 4647

SEQ ID NO: 4650 - RNA, 74 nt, Homo Sapiens; identical to SEQ ID NO: 4647

SEQ ID NO: 4651 - RNA, 74 nt, Homo Sapiens; identical to SEQ ID NO: 4647

SEQ ID NO: 4652 - RNA, 75 nt, Homo Sapiens
gcuggacgagcugaccuuggaagggguggcccgguacaugcagagcgaacgcugucgcagagucaucuguuuggu

SEQ ID NO: 4653 - RNA, 24 nt, Homo Sapiens
ugaccuuggaagggguggcccggu

SEQ ID NO: 4654 - RNA, 22 nt, Homo Sapiens
accuucagaggggguggcccgg

SEQ ID NO: 4655 - RNA, 19 nt, Homo Sapiens
accuagcacagggguggcc

SEQ ID NO: 4656 - RNA, 23 nt, Homo Sapiens
acauaggaagcgugguggcccgg

SEQ ID NO: 4657 - RNA, 22 nt, Homo Sapiens
ccauggaaggggguagccaggu

SEQ ID NO: 4658 - RNA, 21 nt, Homo Sapiens
ccuuggaaggugcacuggccc

SEQ ID NO: 4659 - RNA, 24 nt, Homo Sapiens
ccguggaaggggccuugcccuggu

SEQ ID NO: 4660 - RNA, 20 nt, Homo Sapiens
cccuggaaggggggcugggu

SEQ ID NO: 4661 - RNA, 21 nt, Homo Sapiens
cuugguugcgcgguggcccgg

SEQ ID NO: 4662 - RNA, 21 nt, Homo Sapiens
ugaccuuggcgaaggggcggc

SEQ ID NO: 4663 - RNA, 22 nt, Homo Sapiens
ugaacuggaaggggcugccggu

SEQ ID NO: 4664 - RNA, 18 nt, Homo Sapiens
ugacuggggagggguggc

SEQ ID NO: 4665 - RNA, 20 nt, Homo Sapiens
uggaaggggaauuagccagg

SEQ ID NO: 4666 - RNA, 19 nt, Homo Sapiens
uggaagggguaccccaggu

SEQ ID NO: 4667 - RNA, 68 nt, Homo Sapiens
gcuggauagcucuggagcagcuuagugugucuggggcagaccgaccaccuucuaucuugagugccagc

SEQ ID NO: 4668 - RNA, 24 nt, Homo Sapiens
uagcucuggagcagcuuagugugu

SEQ ID NO: 4669 - RNA, 20 nt, Homo Sapiens
agcucuggaagugcagauua

SEQ ID NO: 4670 - RNA, 20 nt, Homo Sapiens
agcucuggagccuacagcuu

SEQ ID NO: 4671 - RNA, 24 nt, Homo Sapiens
agcucuggaacaacguauuugugu

SEQ ID NO: 4672 - RNA, 18 nt, Homo Sapiens
agcggugggagcuuagug

SEQ ID NO: 4673 - RNA, 18 nt, Homo Sapiens
agcuguggggcuuagugu

SEQ ID NO: 4674 - RNA, 22 nt, Homo Sapiens
gcucuggagaaggcuguggugu

SEQ ID NO: 4675 - RNA, 21 nt, Homo Sapiens
gcucuggaggaugcucaggug

SEQ ID NO: 4676 - RNA, 22 nt, Homo Sapiens
gcucuggaguaacuuugaugug

SEQ ID NO: 4677 - RNA, 17 nt, Homo Sapiens
uagcucugggcaguuag

SEQ ID NO: 4678 - RNA, 19 nt, Homo Sapiens
uagcucugggggaggugag

SEQ ID NO: 4679 - RNA, 18 nt, Homo Sapiens
ucuggagcagcaggugug

SEQ ID NO: 4680 - RNA, 84 nt, Homo Sapiens
gcugugacugccugcaggguuuccagcugacccacaucccuggguggggggacugggucugggauggguacccucaucaucagc

SEQ ID NO: 4681 - RNA, 24 nt, Homo Sapiens
ugcaggguuuccagcugacccaca

SEQ ID NO: 4682 - RNA, 21 nt, Homo Sapiens
aggguggcacacugacccaca

SEQ ID NO: 4683 - RNA, 23 nt, Homo Sapiens
caggcagcuuccagcugauccca

SEQ ID NO: 4684 - RNA, 22 nt, Homo Sapiens
caggguuucaccaugcugccca

SEQ ID NO: 4685 - RNA, 24 nt, Homo Sapiens
cagccuuuccagcugucuucccac

SEQ ID NO: 4686 - RNA, 18 nt, Homo Sapiens
caggguuaucugacccac

SEQ ID NO: 4687 - RNA, 22 nt, Homo Sapiens
cagagaguacaucugacccaca

SEQ ID NO: 4688 - RNA, 26 nt, Homo Sapiens
gcagugguauguuccagcugacucca

SEQ ID NO: 4689 - RNA, 23 nt, Homo Sapiens
gcagaagaucccagcugaccaca

SEQ ID NO: 4690 - RNA, 18 nt, Homo Sapiens
gcaggguuugcaguggcc

SEQ ID NO: 4691 - RNA, 17 nt, Homo Sapiens
gcaggguucugacccac

SEQ ID NO: 4692 - RNA, 19 nt, Homo Sapiens
gggucucuccagcugaccc

SEQ ID NO: 4693 - RNA, 20 nt, Homo Sapiens
ugcagcuuggguuccagcug

SEQ ID NO: 4694 - RNA, 20 nt, Homo Sapiens
ugcaggguuucaaccaccug

SEQ ID NO: 4695 - RNA, 22 nt, Homo Sapiens
ugcaggguucaggccugacgca

SEQ ID NO: 4696 - RNA, 19 nt, Homo Sapiens
ugcauuacgagcugaccca

SEQ ID NO: 4697 - RNA, 22 nt, Homo Sapiens
ugcagacuuuccagcugacuca

SEQ ID NO: 4698 - RNA, 19 nt, Homo Sapiens
ugcaggguuugcugccuca

SEQ ID NO: 4699 - RNA, 21 nt, Homo Sapiens
ugcagcucccacugacccaca

SEQ ID NO: 4700 - RNA, 21 nt, Homo Sapiens
ugccagguuuccagacccaca

SEQ ID NO: 4701 - RNA, 67 nt, Homo Sapiens
gcuuccuucgucuaccacucugugccagcuccaacagaccuggcaacuaauaggacuagaaggaggc

SEQ ID NO: 4702 - RNA, 24 nt, Homo Sapiens
ggcaacuaauaggacuagaaggag

SEQ ID NO: 4703 - RNA, 20 nt, Homo Sapiens
aauuuauaggacuagaauga

SEQ ID NO: 4704 - RNA, 18 nt, Homo Sapiens
aaguauuaguagaaggag

SEQ ID NO: 4705 - RNA, 19 nt, Homo Sapiens
aauaggacucagcaagcag

SEQ ID NO: 4706 - RNA, 18 nt, Homo Sapiens
caacuaguacuagaagga

SEQ ID NO: 4707 - RNA, 20 nt, Homo Sapiens
cuagaagagauuagaaggag

SEQ ID NO: 4708 - RNA, 18 nt, Homo Sapiens
cuaauaggauaguaagga

SEQ ID NO: 4709 - RNA, 22 nt, Homo Sapiens
gcaaguauguuaagacuagaag

SEQ ID NO: 4710 - RNA, 20 nt, Homo Sapiens
gcaacuuauaaaggacuaga

SEQ ID NO: 4711 - RNA, 19 nt, Homo Sapiens
gcuacaaauaggacuauaa

SEQ ID NO: 4712 - RNA, 26 nt, Homo Sapiens
ggcagaguaaugugguaacuagaagg

SEQ ID NO: 4713 - RNA, 24 nt, Homo Sapiens
ggcuacagaauaggacugagggag

SEQ ID NO: 4714 - RNA, 16 nt, Homo Sapiens
ggcaacuaaggcuaga

SEQ ID NO: 4715 - RNA, 18 nt, Homo Sapiens
ggcaacuaacaacuacaa

SEQ ID NO: 4716 - RNA, 21 nt, Homo Sapiens
ggcaucacaagauagaaggag

SEQ ID NO: 4717 - RNA, 20 nt, Homo Sapiens
uacuaggcuaacuagaagga

SEQ ID NO: 4718 - RNA, 20 nt, Homo Sapiens
uaauaggacuaugccaggag

SEQ ID NO: 4719 - RNA, 89 nt, Homo Sapiens
gcuucuugcugaucagagcuugguuggcacagccgggguccucgcccucggcccugcuguucucccggaucgcucugauccagcccagc

SEQ ID NO: 4720 - RNA, 24 nt, Homo Sapiens
ucagagcuugguuggcacagccgg

SEQ ID NO: 4721 - RNA, 19 nt, Homo Sapiens
agugcuaggcuuggcacag

SEQ ID NO: 4722 - RNA, 19 nt, Homo Sapiens
agugcugggauuggcacag

SEQ ID NO: 4723 - RNA, 23 nt, Homo Sapiens
agagcuuggcgugucccacccgg

SEQ ID NO: 4724 - RNA, 24 nt, Homo Sapiens
agacguugggaaauggcacagccg

SEQ ID NO: 4725 - RNA, 20 nt, Homo Sapiens
agagcuugguaguuucacag

SEQ ID NO: 4726 - RNA, 19 nt, Homo Sapiens
agagcugguuggcagggcc

SEQ ID NO: 4727 - RNA, 19 nt, Homo Sapiens
cagggcuauuguuggcaca

SEQ ID NO: 4728 - RNA, 21 nt, Homo Sapiens
cagagcccaggguggcacagc

SEQ ID NO: 4729 - RNA, 18 nt, Homo Sapiens
cagaggugguuggcaaag

SEQ ID NO: 4730 - RNA, 20 nt, Homo Sapiens
cagagcuuggugccaaaccc

SEQ ID NO: 4731 - RNA, 21 nt, Homo Sapiens
cagagcuuggcuggcaucgcc

SEQ ID NO: 4732 - RNA, 18 nt, Homo Sapiens
cagagcuuggucccagcc

SEQ ID NO: 4733 - RNA, 22 nt, Homo Sapiens
caguccuuguuggcacacucgg

SEQ ID NO: 4734 - RNA, 17 nt, Homo Sapiens
gagcugauggcacagcc

SEQ ID NO: 4735 - RNA, 19 nt, Homo Sapiens
gagcuugguaggcauggcc

SEQ ID NO: 4736 - RNA, 17 nt, Homo Sapiens
ucagagcuuugggcaca

SEQ ID NO: 4737 - RNA, 21 nt, Homo Sapiens
ucugaccugcuuuggcacagc

SEQ ID NO: 4738 - RNA, 76 nt, Homo Sapiens
gcuugcacgcagaggcgggcggcagacggugcccggcggaaucuccugagcuccgccgcccagcucuggugccagc

SEQ ID NO: 4739 - RNA, 24 nt, Homo Sapiens
gagcuccgccgcccagcucuggug

SEQ ID NO: 4740 - RNA, 26 nt, Homo Sapiens
agcuaccgccgcccuagccgcugcug

SEQ ID NO: 4741 - RNA, 21 nt, Homo Sapiens
agcucacacugccagcucugg

SEQ ID NO: 4742 - RNA, 19 nt, Homo Sapiens
agcccagcucgcccagcuc

SEQ ID NO: 4743 - RNA, 22 nt, Homo Sapiens
agcuccgcccacagcccgcucu

SEQ ID NO: 4744 - RNA, 21 nt, Homo Sapiens
agcuccuccccgcccagcccu

SEQ ID NO: 4745 - RNA, 21 nt, Homo Sapiens
agcuccccagagccagcucug

SEQ ID NO: 4746 - RNA, 22 nt, Homo Sapiens
agcuccgccgccgcggcuccgg

SEQ ID NO: 4747 - RNA, 17 nt, Homo Sapiens
agcuccgccccagcccu

SEQ ID NO: 4748 - RNA, 19 nt, Homo Sapiens
agcuccgcccacagcugug

SEQ ID NO: 4749 - RNA, 19 nt, Homo Sapiens
agcucagguccagcucugg

SEQ ID NO: 4750 - RNA, 22 nt, Homo Sapiens
cuccagccgcccagcccacgug

SEQ ID NO: 4751 - RNA, 19 nt, Homo Sapiens
cuccgcccgcccagccucu

SEQ ID NO: 4752 - RNA, 21 nt, Homo Sapiens
cucagccgcccaguuagcugg

SEQ ID NO: 4753 - RNA, 18 nt, Homo Sapiens
cucccugcacagcucugg

SEQ ID NO: 4754 - RNA, 19 nt, Homo Sapiens
cucccuggcccagcucugg

SEQ ID NO: 4755 - RNA, 18 nt, Homo Sapiens
cuccgccgccgcucggug

SEQ ID NO: 4756 - RNA, 21 nt, Homo Sapiens
gagcucacgccgcccaggcuc

SEQ ID NO: 4757 - RNA, 27 nt, Homo Sapiens
gagcccccagcagccccugcucuggug

SEQ ID NO: 4758 - RNA, 24 nt, Homo Sapiens
gagcuccgcacugagcccaacucu

SEQ ID NO: 4759 - RNA, 19 nt, Homo Sapiens
gagcuccgccaccagcagc

SEQ ID NO: 4760 - RNA, 19 nt, Homo Sapiens
gagcugccacccagcucug

SEQ ID NO: 4761 - RNA, 21 nt, Homo Sapiens
gagucccuggcccagcucugg

SEQ ID NO: 4762 - RNA, 22 nt, Homo Sapiens
gagccaccacacccagcucugg

SEQ ID NO: 4763 - RNA, 20 nt, Homo Sapiens
gagcucugacccagcucugg

SEQ ID NO: 4764 - RNA, 22 nt, Homo Sapiens
gagccccagcccagcucaagug

SEQ ID NO: 4765 - RNA, 21 nt, Homo Sapiens
gcucccagccgcccagggcug

SEQ ID NO: 4766 - RNA, 21 nt, Homo Sapiens
gcuucgccugugcccagcucu

SEQ ID NO: 4767 - RNA, 23 nt, Homo Sapiens
gcgccgccgcccagacuccgcug

SEQ ID NO: 4768 - RNA, 19 nt, Homo Sapiens
gcgccgccgccccucgggu

SEQ ID NO: 4769 - RNA, 20 nt, Homo Sapiens
gcuuggucgcccagcuuggu

SEQ ID NO: 4770 - RNA, 19 nt, Homo Sapiens
uccggcccucccagcucug

SEQ ID NO: 4771 - RNA, 77 nt, Homo Sapiens
gcuuggccuaugacaggucaccguguguaaaucuuucccaauaaaguguugcacaaaggcauccuguccgugcaggu

SEQ ID NO: 4772 - RNA, 24 nt, Homo Sapiens
ugacaggucaccguguguaaaucu

SEQ ID NO: 4773 - RNA, 23 nt, Homo Sapiens
acaggucacccuguaacaaaucu

SEQ ID NO: 4774 - RNA, 18 nt, Homo Sapiens
acaggucacuaugaaaau

SEQ ID NO: 4775 - RNA, 18 nt, Homo Sapiens
acaggucacacuggaaau

SEQ ID NO: 4776 - RNA, 19 nt, Homo Sapiens
caagucacagccgugugua

SEQ ID NO: 4777 - RNA, 20 nt, Homo Sapiens
caggucaccuugugcaaucu

SEQ ID NO: 4778 - RNA, 17 nt, Homo Sapiens
gaaagguguguguaaau

SEQ ID NO: 4779 - RNA, 23 nt, Homo Sapiens
ggucuccaguggcuuguaaaucu

SEQ ID NO: 4780 - RNA, 24 nt, Homo Sapiens
ugacaaauggucuacuguguaaau

SEQ ID NO: 4781 - RNA, 72 nt, Homo Sapiens
gcuuuuaacuuggacuaguguaacuccuucaugcaauaaacugaaaagagccaugcugucuagucuugaagu

SEQ ID NO: 4782 - RNA, 24 nt, Homo Sapiens
aaaagagccaugcugucuagucuu

SEQ ID NO: 4783 - RNA, 23 nt, Homo Sapiens
aaaagugaugccaugcuguguag

SEQ ID NO: 4784 - RNA, 23 nt, Homo Sapiens
aaaagagccagcuguuccagccu

SEQ ID NO: 4785 - RNA, 19 nt, Homo Sapiens
aaaagagccaagcuguuag

SEQ ID NO: 4786 - RNA, 22 nt, Homo Sapiens
aaaauagccaugcuugaagucu

SEQ ID NO: 4787 - RNA, 19 nt, Homo Sapiens
aaagagccaacugcucucu

SEQ ID NO: 4788 - RNA, 20 nt, Homo Sapiens
aaggagccaagugcugucua

SEQ ID NO: 4789 - RNA, 19 nt, Homo Sapiens
aaagagccagggcagucua

SEQ ID NO: 4790 - RNA, 21 nt, Homo Sapiens
aaagagccauuuguuuuaguc

SEQ ID NO: 4791 - RNA, 21 nt, Homo Sapiens
aaagagccauuguccaauuuu

SEQ ID NO: 4792 - RNA, 19 nt, Homo Sapiens
aagagccaugauguugucu

SEQ ID NO: 4793 - RNA, 19 nt, Homo Sapiens
agggcacaugcugucaguc

SEQ ID NO: 4794 - RNA, 26 nt, Homo Sapiens
agagacacuaugcugucugaguucuu

SEQ ID NO: 4795 - RNA, 19 nt, Homo Sapiens
agagccaugcugugcaagu

SEQ ID NO: 4796 - RNA, 17 nt, Homo Sapiens
agccaugcucuugucuu

SEQ ID NO: 4797 - RNA, 17 nt, Homo Sapiens
gagccaugcgucuucuu

SEQ ID NO: 4798 - RNA, 79 nt, Homo Sapiens
gcuuuucuaguuugcaacuucuaaucugcugugagucaggaaaacauauggcagaguuaaauugugcuuuugguuaggu

SEQ ID NO: 4799 - RNA, 24 nt, Homo Sapiens
uggcagaguuaaauugugcuuuug

SEQ ID NO: 4800 - RNA, 19 nt, Homo Sapiens
agauuaagagugugcuuuu

SEQ ID NO: 4801 - RNA, 19 nt, Homo Sapiens
agauuuauuuugugcuuuu

SEQ ID NO: 4802 - RNA, 20 nt, Homo Sapiens
agaggagaguugugcuuuug

SEQ ID NO: 4803 - RNA, 19 nt, Homo Sapiens
caaauuuaaauuguucuuu

SEQ ID NO: 4804 - RNA, 20 nt, Homo Sapiens
cagaguuaaaauacacuuuu

SEQ ID NO: 4805 - RNA, 21 nt, Homo Sapiens
gcagaacauaaauugugauuu

SEQ ID NO: 4806 - RNA, 19 nt, Homo Sapiens
gcagaauuaugugcuuuug

SEQ ID NO: 4807 - RNA, 20 nt, Homo Sapiens
gcagaguuaguuggcuucug

SEQ ID NO: 4808 - RNA, 17 nt, Homo Sapiens
uggcacaaaauugugcu

SEQ ID NO: 4809 - RNA, 22 nt, Homo Sapiens
ugacauagauaguugugcuuuu

SEQ ID NO: 4810 - RNA, 23 nt, Homo Sapiens
uggagaaaugaaaugugcuuuug

SEQ ID NO: 4811 - RNA, 20 nt, Homo Sapiens
uggcagaguauucgcuucug

SEQ ID NO: 4812 - RNA, 87 nt, Homo Sapiens
ggaaaugguuauugaaucagauagaccaguucuguugagggucuuaaagagucucaauuuucucaucuauaaaaccaauaccuuucc

SEQ ID NO: 4813 - RNA, 24 nt, Homo Sapiens
ucagauagaccaguucuguugagg

SEQ ID NO: 4814 - RNA, 22 nt, Homo Sapiens
auauaccaguuacuucuguuga

SEQ ID NO: 4815 - RNA, 20 nt, Homo Sapiens
auagaccagagcugguaagg

SEQ ID NO: 4816 - RNA, 21 nt, Homo Sapiens
uagcccagguuacuguugagg

SEQ ID NO: 4817 - RNA, 23 nt, Homo Sapiens
ucaaaaagagcaguguucuguug

SEQ ID NO: 4818 - RNA, 22 nt, Homo Sapiens
ucagaauacagcccuguugagg

SEQ ID NO: 4819 - RNA, 67 nt, Homo Sapiens
ggaacaugacagcaggcacacucauggaauacaauggguuuuccaugcacccugucauccucagucc

SEQ ID NO: 4820 - RNA, 24 nt, Homo Sapiens
ugacagcaggcacacucauggaau

SEQ ID NO: 4821 - RNA, 19 nt, Homo Sapiens
acagacaggcacaccccug

SEQ ID NO: 4822 - RNA, 19 nt, Homo Sapiens
acagcaggcagcccucugg

SEQ ID NO: 4823 - RNA, 18 nt, Homo Sapiens
acagcaggccccucgugg

SEQ ID NO: 4824 - RNA, 20 nt, Homo Sapiens
acagaaaacaccucauggaa

SEQ ID NO: 4825 - RNA, 25 nt, Homo Sapiens
cagcagaugccggacacucaugaaa

SEQ ID NO: 4826 - RNA, 22 nt, Homo Sapiens
cagcagagggagcacucaugga

SEQ ID NO: 4827 - RNA, 18 nt, Homo Sapiens
cagaggcacacuuaugga

SEQ ID NO: 4828 - RNA, 22 nt, Homo Sapiens
ugacacagagcacacacucaug

SEQ ID NO: 4829 - RNA, 23 nt, Homo Sapiens
ugacagcagugcaaacaaugaaa

SEQ ID NO: 4830 - RNA, 23 nt, Homo Sapiens
ugaaaccagggcaaacucaugga

SEQ ID NO: 4831 - RNA, 26 nt, Homo Sapiens
ugacacuuggcaccauucucauggaa

SEQ ID NO: 4832 - RNA, 25 nt, Homo Sapiens
ugacagcagccacagccuccaggga

SEQ ID NO: 4833 - RNA, 17 nt, Homo Sapiens
ugaagcaggcacaucau

SEQ ID NO: 4834 - RNA, 18 nt, Homo Sapiens
ugacagcagcacagacau

SEQ ID NO: 4835 - RNA, 18 nt, Homo Sapiens
ugacagcagugacaucau

SEQ ID NO: 4836 - RNA, 18 nt, Homo Sapiens
ugacagcagcaguccugg

SEQ ID NO: 4837 - RNA, 20 nt, Homo Sapiens
ugacagcagggcacgcaggg

SEQ ID NO: 4838 - RNA, 21 nt, Homo Sapiens
ugagagcaggcacagugcugg

SEQ ID NO: 4839 - RNA, 20 nt, Homo Sapiens
ugacagcagccucaccugga

SEQ ID NO: 4840 - RNA, 23 nt, Homo Sapiens
ugacagcagacauacccaagcaa

SEQ ID NO: 4841 - RNA, 23 nt, Homo Sapiens
ugaaaguggcacacucaugguau

SEQ ID NO: 4842 - RNA, 21 nt, Homo Sapiens
ugacagcagagacuuuggaau

SEQ ID NO: 4843 - RNA, 63 nt, Homo Sapiens
ggaagaccguaauuguggcugcacuggaugggaccuuccagaggaagccauuuggggccaucc

SEQ ID NO: 4844 - RNA, 24 nt, Homo Sapiens
agaccguaauuguggcugcacugg

SEQ ID NO: 4845 - RNA, 21 nt, Homo Sapiens
accauaauuacugcugcacug

SEQ ID NO: 4846 - RNA, 22 nt, Homo Sapiens
agaccuacauaacuguggcugc

SEQ ID NO: 4847 - RNA, 24 nt, Homo Sapiens
agaucguuaucuggacugcacugg

SEQ ID NO: 4848 - RNA, 22 nt, Homo Sapiens
agaccguaaugucugacccugg

SEQ ID NO: 4849 - RNA, 18 nt, Homo Sapiens
agaccuagguguggcugc

SEQ ID NO: 4850 - RNA, 23 nt, Homo Sapiens
agagcugaugcugucugcacugg

SEQ ID NO: 4851 - RNA, 24 nt, Homo Sapiens
ccauaagucuugagucugcacugg

SEQ ID NO: 4852 - RNA, 22 nt, Homo Sapiens
gaccagagaaguuguggcugca

SEQ ID NO: 4853 - RNA, 22 nt, Homo Sapiens
gaccugugaggcggcugcacug

SEQ ID NO: 4854 - RNA, 23 nt, Homo Sapiens
gagccuuacuguggcugcaucug

SEQ ID NO: 4855 - RNA, 19 nt, Homo Sapiens
guaauauauugcugcacug

SEQ ID NO: 4856 - RNA, 19 nt, Homo Sapiens
guaauugugucacugcacu

SEQ ID NO: 4857 - RNA, 19 nt, Homo Sapiens
guaacaguggcugcacugg

SEQ ID NO: 4858 - RNA, 127 nt, Homo Sapiens
ggaagccgucagccaagucgccacauuucucugcaaaaugucauagcuuauauuaauguacaguauuccaugguaugcugccuuccguuguaaguagcagaucucuccgugacuugacacggcuacu

SEQ ID NO: 4859 - RNA, 24 nt, Homo Sapiens
ugucauagcuuauauuaauguaca

SEQ ID NO: 4860 - RNA, 19 nt, Homo Sapiens
caaagcuauuauauuaaug

SEQ ID NO: 4861 - RNA, 22 nt, Homo Sapiens
gucaagacuugauauuaaugua

SEQ ID NO: 4862 - RNA, 21 nt, Homo Sapiens
ucauagcuuaaauccauugua

SEQ ID NO: 4863 - RNA, 21 nt, Homo Sapiens
ucauagcuuauaaacauuaca

SEQ ID NO: 4864 - RNA, 22 nt, Homo Sapiens
ucuuugcacauauuaauguuca

SEQ ID NO: 4865 - RNA, 23 nt, Homo Sapiens
ugugcauagcuuauagcacugua

SEQ ID NO: 4866 - RNA, 26 nt, Homo Sapiens
uguccauaucugcaaaguaauguaca

SEQ ID NO: 4867 - RNA, 25 nt, Homo Sapiens
ugacauagcuuauaauuaaguuaca

SEQ ID NO: 4868 - RNA, 20 nt, Homo Sapiens
uguaauauuucauauuaaug

SEQ ID NO: 4869 - RNA, 18 nt, Homo Sapiens
ugucauagcaauauaaug

SEQ ID NO: 4870 - RNA, 19 nt, Homo Sapiens
ugucagcaaauauuaaugu

SEQ ID NO: 4871 - RNA, 22 nt, Homo Sapiens
ugucucugcauaaauuaaugua

SEQ ID NO: 4872 - RNA, 20 nt, Homo Sapiens
uguuaugguauauuaaugua

SEQ ID NO: 4873 - RNA, 69 nt, Homo Sapiens
ggaagcucuuugccccacagcagauucugcaaugcaggccugacaacugagggaacugcgagggccgcc

SEQ ID NO: 4874 - RNA, 24 nt, Homo Sapiens
ugacaacugagggaacugcgaggg

SEQ ID NO: 4875 - RNA, 19 nt, Homo Sapiens
acaacugaguggaagaggg

SEQ ID NO: 4876 - RNA, 23 nt, Homo Sapiens
acaacugaggaugcugcaggagg

SEQ ID NO: 4877 - RNA, 22 nt, Homo Sapiens
acagcagaugcuccagaaaugc

SEQ ID NO: 4878 - RNA, 23 nt, Homo Sapiens
acagcagauaauggacacugcag

SEQ ID NO: 4879 - RNA, 22 nt, Homo Sapiens
acagcagauuuuucacauugca

SEQ ID NO: 4880 - RNA, 17 nt, Homo Sapiens
acagcagauacugugca

SEQ ID NO: 4881 - RNA, 20 nt, Homo Sapiens
acugagggaaggcggcgggg

SEQ ID NO: 4882 - RNA, 22 nt, Homo Sapiens
agcagaaugcagaaaugcaggc

SEQ ID NO: 4883 - RNA, 20 nt, Homo Sapiens
agcagguuccugcaaugcag

SEQ ID NO: 4884 - RNA, 21 nt, Homo Sapiens
agcagauucuccagaauggag

SEQ ID NO: 4885 - RNA, 23 nt, Homo Sapiens
aggacauucugcaaaagugcagg

SEQ ID NO: 4886 - RNA, 18 nt, Homo Sapiens
agcacauucugcaaaggc

SEQ ID NO: 4887 - RNA, 19 nt, Homo Sapiens
caacugagggaugcuggag

SEQ ID NO: 4888 - RNA, 20 nt, Homo Sapiens
caauuaaccgaacugcgagg

SEQ ID NO: 4889 - RNA, 26 nt, Homo Sapiens
cacagcagaggcauucuaauccaggc

SEQ ID NO: 4890 - RNA, 20 nt, Homo Sapiens
cacagcagaguucuucagug

SEQ ID NO: 4891 - RNA, 21 nt, Homo Sapiens
cacagcagauuugagcaaugc

SEQ ID NO: 4892 - RNA, 23 nt, Homo Sapiens
cacagcagauuugcuaaaaagca

SEQ ID NO: 4893 - RNA, 20 nt, Homo Sapiens
cagagcagguuucugcaaug

SEQ ID NO: 4894 - RNA, 22 nt, Homo Sapiens
cacagcagagacucgcaggcag

SEQ ID NO: 4895 - RNA, 23 nt, Homo Sapiens
cagagcuguucugcaauaugcag

SEQ ID NO: 4896 - RNA, 18 nt, Homo Sapiens
cacacagauucugcauug

SEQ ID NO: 4897 - RNA, 18 nt, Homo Sapiens
cacagcagaccugccaug

SEQ ID NO: 4898 - RNA, 23 nt, Homo Sapiens
cauagcucacucugcaaugucag

SEQ ID NO: 4899 - RNA, 19 nt, Homo Sapiens
cacagcagaugccacugca

SEQ ID NO: 4900 - RNA, 19 nt, Homo Sapiens
cacagcagagucuauacag

SEQ ID NO: 4901 - RNA, 21 nt, Homo Sapiens
cacgacaauucugcaauggag

SEQ ID NO: 4902 - RNA, 21 nt, Homo Sapiens
cacaccauacugcaaugcugg

SEQ ID NO: 4903 - RNA, 21 nt, Homo Sapiens
cacaggacuguucaaugcagg

SEQ ID NO: 4904 - RNA, 21 nt, Homo Sapiens
cagagcggauggaaugcaggc

SEQ ID NO: 4905 - RNA, 24 nt, Homo Sapiens
cagauucucuccugcaaugccagg

SEQ ID NO: 4906 - RNA, 19 nt, Homo Sapiens
caccagauucugacagugc

SEQ ID NO: 4907 - RNA, 19 nt, Homo Sapiens
caacagauucugcugcugg

SEQ ID NO: 4908 - RNA, 21 nt, Homo Sapiens
cagcagauucugcacuccagg

SEQ ID NO: 4909 - RNA, 21 nt, Homo Sapiens
caccagauucugggagcaggc

SEQ ID NO: 4910 - RNA, 18 nt, Homo Sapiens
gacacugagggaaucugc

SEQ ID NO: 4911 - RNA, 25 nt, Homo Sapiens
gacaacugagucuccugcgugaggg

SEQ ID NO: 4912 - RNA, 22 nt, Homo Sapiens
gacaacugagggucuccgcagg

SEQ ID NO: 4913 - RNA, 18 nt, Homo Sapiens
gacaacugaacuggaggg

SEQ ID NO: 4914 - RNA, 19 nt, Homo Sapiens
gcggauucugcagacaggc

SEQ ID NO: 4915 - RNA, 19 nt, Homo Sapiens
ugccagacugagggagcug

SEQ ID NO: 4916 - RNA, 22 nt, Homo Sapiens
ugacaaguccuugggaacugcg

SEQ ID NO: 4917 - RNA, 25 nt, Homo Sapiens
ugagaacugagggaccugccugagg

SEQ ID NO: 4918 - RNA, 63 nt, Homo Sapiens
ggaaggcagccaagaggaagugggcggcacagaccauccggcggcucauccgaggcuucaucc

SEQ ID NO: 4919 - RNA, 24 nt, Homo Sapiens
aggcagccaagaggaagugggcgg

SEQ ID NO: 4920 - RNA, 22 nt, Homo Sapiens
gcagccaagagagcguggagcg

SEQ ID NO: 4921 - RNA, 21 nt, Homo Sapiens
gcuggcaaggggaagugggcg

SEQ ID NO: 4922 - RNA, 20 nt, Homo Sapiens
ggcggccaaggaaguggacg

SEQ ID NO: 4923 - RNA, 65 nt, Homo Sapiens
ggaauaaaaauaacaacucuuugugggcgcggcguuuugggcccgagaagagguuuuuuuaaacc

SEQ ID NO: 4924 - RNA, 24 nt, Homo Sapiens
uaaaaauaacaacucuuugugggc

SEQ ID NO: 4925 - RNA, 22 nt, Homo Sapiens
aaaaauaguaccuucuuugugg

SEQ ID NO: 4926 - RNA, 19 nt, Homo Sapiens
aaaauaacaaugacucuuu

SEQ ID NO: 4927 - RNA, 22 nt, Homo Sapiens
aaaauaacaacauucucguggg

SEQ ID NO: 4928 - RNA, 21 nt, Homo Sapiens
aaaauaacauuuaauuugugg

SEQ ID NO: 4929 - RNA, 20 nt, Homo Sapiens
aaaagcacaacucuuggagg

SEQ ID NO: 4930 - RNA, 19 nt, Homo Sapiens
aaagagcagccuuuguggg

SEQ ID NO: 4931 - RNA, 21 nt, Homo Sapiens
uaaaaaagcucacaacucuuu

SEQ ID NO: 4932 - RNA, 21 nt, Homo Sapiens
uaaaaauguaacaacucugug

SEQ ID NO: 4933 - RNA, 24 nt, Homo Sapiens
uaacaauauguacaacucuuaugu

SEQ ID NO: 4934 - RNA, 22 nt, Homo Sapiens
uaaaaauaacaguacaccuugu

SEQ ID NO: 4935 - RNA, 22 nt, Homo Sapiens
uaaaaauaaaaacauucuucgu

SEQ ID NO: 4936 - RNA, 24 nt, Homo Sapiens
uaacacaaacaaccucuuuguggg

SEQ ID NO: 4937 - RNA, 22 nt, Homo Sapiens
uaaaaauaacacuuuccugugg

SEQ ID NO: 4938 - RNA, 20 nt, Homo Sapiens
uaaaaauaacaaggcugugu

SEQ ID NO: 4939 - RNA, 21 nt, Homo Sapiens
uaaaaauaacagauguuggug

SEQ ID NO: 4940 - RNA, 23 nt, Homo Sapiens
uaaaaauaaagccucuuuauugg

SEQ ID NO: 4941 - RNA, 23 nt, Homo Sapiens
uaaaaauaaaucccucuguaggc

SEQ ID NO: 4942 - RNA, 95 nt, Homo Sapiens
ggaaucucgaagcugcuaaaugaguuccacgaagaacuugccuccaauuaaaaggcgcguauuuauauaccuuucauagggcggggggagauuuu

SEQ ID NO: 4943 - RNA, 24 nt, Homo Sapiens
aaugaguuccacgaagaacuugcc

SEQ ID NO: 4944 - RNA, 22 nt, Homo Sapiens
aaugaguucuaaacggggaacu

SEQ ID NO: 4945 - RNA, 21 nt, Homo Sapiens
aaugaguuccccuacaaauaa

SEQ ID NO: 4946 - RNA, 21 nt, Homo Sapiens
aaugaguuccccaauaggaac

SEQ ID NO: 4947 - RNA, 24 nt, Homo Sapiens
aaugaguucaaaaagcacguuugc

SEQ ID NO: 4948 - RNA, 18 nt, Homo Sapiens
aauggguaugaagaacuu

SEQ ID NO: 4949 - RNA, 19 nt, Homo Sapiens
aguuucacgaagaacgugc

SEQ ID NO: 4950 - RNA, 21 nt, Homo Sapiens
auaauuuaaacaagaacuugc

SEQ ID NO: 4951 - RNA, 20 nt, Homo Sapiens
gagaucucgcgagaacuugc

SEQ ID NO: 4952 - RNA, 20 nt, Homo Sapiens
gagguccagaaagaacuugc

SEQ ID NO: 4953 - RNA, 21 nt, Homo Sapiens
gacucccacguagaacuugcc

SEQ ID NO: 4954 - RNA, 25 nt, Homo Sapiens
ugagcccucccacgaagagcuuucc

SEQ ID NO: 4955 - RNA, 21 nt, Homo Sapiens
ugaguuccaugagcaaaaacu

SEQ ID NO: 4956 - RNA, 18 nt, Homo Sapiens
uguguuccacgagaccuu

SEQ ID NO: 4957 - RNA, 21 nt, Homo Sapiens
uuacacugagaagaacuuucc

SEQ ID NO: 4958 - RNA, 69 nt, Homo Sapiens
ggaaugagaauaccugaaaccaaaccguuaacaaggaaugguagugaaguuaaggaguuagcucauucu

SEQ ID NO: 4959 - RNA, 24 nt, Homo Sapiens
ugagaauaccugaaaccaaaccgu

SEQ ID NO: 4960 - RNA, 19 nt, Homo Sapiens
aauacaagaaaaccaaacc

SEQ ID NO: 4961 - RNA, 21 nt, Homo Sapiens
aauaccugacaucaacacggu

SEQ ID NO: 4962 - RNA, 20 nt, Homo Sapiens
aaucccugaaaccucacagu

SEQ ID NO: 4963 - RNA, 18 nt, Homo Sapiens
agacauacugaaaccaaa

SEQ ID NO: 4964 - RNA, 17 nt, Homo Sapiens
agcauaccaaaccaaac

SEQ ID NO: 4965 - RNA, 19 nt, Homo Sapiens
agaaacaagaaaccaaacc

SEQ ID NO: 4966 - RNA, 21 nt, Homo Sapiens
gaaaaccugucaaaaccaaac

SEQ ID NO: 4967 - RNA, 22 nt, Homo Sapiens
gagacuucaaccugaaaccaaa

SEQ ID NO: 4968 - RNA, 21 nt, Homo Sapiens
ugagaauacacaggaacaaaa

SEQ ID NO: 4969 - RNA, 23 nt, Homo Sapiens
ugagaauacacgaguccaaagcg

SEQ ID NO: 4970 - RNA, 92 nt, Homo Sapiens
ggacaccaucuuuauaaaaguaaaacuucuagauccugaaauguacuacaguagagucuauaguuuacacuuuuaaucacagauuggaauuc

SEQ ID NO: 4971 - RNA, 24 nt, Homo Sapiens
uaaaaguaaaacuucuagauccug

SEQ ID NO: 4972 - RNA, 18 nt, Homo Sapiens
aaaaguaaaauuucugau

SEQ ID NO: 4973 - RNA, 22 nt, Homo Sapiens
aaacuaaacacugcuucuagau

SEQ ID NO: 4974 - RNA, 68 nt, Homo Sapiens
ggaccaacugauaccucgcuauguagcuuuacuccuuuauccucuagguggcguauuagaauggugcc

SEQ ID NO: 4975 - RNA, 21 nt, Homo Sapiens
guggcguauuagaauggugcc

SEQ ID NO: 4976 - RNA, 20 nt, Homo Sapiens
guggugguauuagaaaugug

SEQ ID NO: 4977 - RNA, 17 nt, Homo Sapiens
guggcuacagaauggug

SEQ ID NO: 4978 - RNA, 19 nt, Homo Sapiens
guggggaaggagaauggug

SEQ ID NO: 4979 - RNA, 64 nt, Homo Sapiens
ggaccugucaccccaccauggagaaaagagucuuuugguucuuuuuaacauaagugauuaguuu

SEQ ID NO: 4980 - RNA, 24 nt, Homo Sapiens
ugucaccccaccauggagaaaaga

SEQ ID NO: 4981 - RNA, 19 nt, Homo Sapiens
accccaccaggaaagaaaa

SEQ ID NO: 4982 - RNA, 19 nt, Homo Sapiens
ccccaaaaaggagaaaaga

SEQ ID NO: 4983 - RNA, 23 nt, Homo Sapiens
gucaccccacggcuauggggaaa

SEQ ID NO: 4984 - RNA, 21 nt, Homo Sapiens
ucacucccaccaugaggcaaa

SEQ ID NO: 4985 - RNA, 22 nt, Homo Sapiens
ucaccagucaccauggagagaa

SEQ ID NO: 4986 - RNA, 26 nt, Homo Sapiens
ugucuacccgccaccauggagccaag

SEQ ID NO: 4987 - RNA, 65 nt, Homo Sapiens
ggagaagcgcgagggcuacgagcgucuccugaagaugcaaaaccagcguggcggccgcgcucucu

SEQ ID NO: 4988 - RNA, 24 nt, Homo Sapiens
ugcaaaaccagcguggcggccgcg

SEQ ID NO: 4989 - RNA, 23 nt, Homo Sapiens
caaaaccagccgggcuggccacg

SEQ ID NO: 4990 - RNA, 19 nt, Homo Sapiens
gcagaaaccagcgugcgcg

SEQ ID NO: 4991 - RNA, 22 nt, Homo Sapiens
gcaaaaccaaggcgguggaggc

SEQ ID NO: 4992 - RNA, 19 nt, Homo Sapiens
gcaaaaccaauuuggcagc

SEQ ID NO: 4993 - RNA, 18 nt, Homo Sapiens
gcaaaaccaugacugccg

SEQ ID NO: 4994 - RNA, 19 nt, Homo Sapiens
ugcacagaaaccagcgugg

SEQ ID NO: 4995 - RNA, 20 nt, Homo Sapiens
ugcaaaaccaacugucucgg

SEQ ID NO: 4996 - RNA, 23 nt, Homo Sapiens
ugaaaaaugggcgcuggcggccg

SEQ ID NO: 4997 - RNA, 20 nt, Homo Sapiens
ugcaaaaccugggugcugcc

SEQ ID NO: 4998 - RNA, 21 nt, Homo Sapiens
ugcagacagcgcggcggccgc

SEQ ID NO: 4999 - RNA, 20 nt, Homo Sapiens
ugcaacacggggcggccgcg

SEQ ID NO: 5000 - RNA, 22 nt, Homo Sapiens
ugcgaagcgacgggcggccgcg

SEQ ID NO: 5001 - RNA, 78 nt, Homo Sapiens
ggagcccuugauguccugcaaaugaaggaggaggauguccuuaaguuccuugcagcaggaacccacuuagguggcacc

SEQ ID NO: 5002 - RNA, 24 nt, Homo Sapiens
guccugcaaaugaaggaggaggau

SEQ ID NO: 5003 - RNA, 23 nt, Homo Sapiens
ccugcaaaucuaggagcacggau

SEQ ID NO: 5004 - RNA, 21 nt, Homo Sapiens
ugccaaggaggaggaggagga

SEQ ID NO: 5005 - RNA, 18 nt, Homo Sapiens
ugcauugcaggaggagga

SEQ ID NO: 5006 - RNA, 73 nt, Homo Sapiens
ggagcggaugggcggcgcgggcggcgagggcagcgacgacgacaccucgcucaccugagcgccgcaccgcuuc

SEQ ID NO: 5007 - RNA, 24 nt, Homo Sapiens
ugggcggcgcgggcggcgagggca

SEQ ID NO: 5008 - RNA, 19 nt, Homo Sapiens
cggcgcggggcggcgcggg

SEQ ID NO: 5009 - RNA, 23 nt, Homo Sapiens
cggcgcgggcugcggcggagggc

SEQ ID NO: 5010 - RNA, 20 nt, Homo Sapiens
cgggcgggcggcgaagggca

SEQ ID NO: 5011 - RNA, 19 nt, Homo Sapiens
cgacgcggguggcgagggc

SEQ ID NO: 5012 - RNA, 19 nt, Homo Sapiens
cgggcccggcggcgagcgc

SEQ ID NO: 5013 - RNA, 19 nt, Homo Sapiens
gcgggcggcggcgcgggca

SEQ ID NO: 5014 - RNA, 21 nt, Homo Sapiens
gcggggccgagcggcgagggc

SEQ ID NO: 5015 - RNA, 20 nt, Homo Sapiens
gcggcucgggcggcggcggc

SEQ ID NO: 5016 - RNA, 20 nt, Homo Sapiens
gcggggccgggggcgagggc

SEQ ID NO: 5017 - RNA, 20 nt, Homo Sapiens
gcggggcgggcggcggcggc

SEQ ID NO: 5018 - RNA, 20 nt, Homo Sapiens
ggcgcgggccggccgggggc

SEQ ID NO: 5019 - RNA, 20 nt, Homo Sapiens
ggcgcgggcggcggcgggca

SEQ ID NO: 5020 - RNA, 24 nt, Homo Sapiens
ggcgggcugcgggcggcacuggca

SEQ ID NO: 5021 - RNA, 21 nt, Homo Sapiens
ggcggcgggcaccgggcggcg

SEQ ID NO: 5022 - RNA, 21 nt, Homo Sapiens
gguggcaccggcgcggcgagg

SEQ ID NO: 5023 - RNA, 26 nt, Homo Sapiens
ggcggcgcggggccgaggcgggggca

SEQ ID NO: 5024 - RNA, 21 nt, Homo Sapiens
ggcggcccggcggcggcgagg

SEQ ID NO: 5025 - RNA, 21 nt, Homo Sapiens
ggcggcggggggcggcgaggg

SEQ ID NO: 5026 - RNA, 24 nt, Homo Sapiens
ggcggcgcgggcaggggcaagggc

SEQ ID NO: 5027 - RNA, 24 nt, Homo Sapiens
gggggcgcgggcgcgcagcgaggg

SEQ ID NO: 5028 - RNA, 24 nt, Homo Sapiens
ggcggcgcgggcgggugcgcgggc

SEQ ID NO: 5029 - RNA, 25 nt, Homo Sapiens
ggcggcgcgggcggggucgagcgca

SEQ ID NO: 5030 - RNA, 22 nt, Homo Sapiens
ggcggugcgggcggcggagagc

SEQ ID NO: 5031 - RNA, 23 nt, Homo Sapiens
gguggcgcgggcggcggcgggca

SEQ ID NO: 5032 - RNA, 22 nt, Homo Sapiens
ggcggcgcgggcggcgggcggc

SEQ ID NO: 5033 - RNA, 18 nt, Homo Sapiens
ggcgcgcgggcggcgcgg

SEQ ID NO: 5034 - RNA, 17 nt, Homo Sapiens
ggcggcgcgcggcgcgg

SEQ ID NO: 5035 - RNA, 19 nt, Homo Sapiens
ggcggcggcggcggcgagg

SEQ ID NO: 5036 - RNA, 20 nt, Homo Sapiens
ggcagcggcggcggcgaggg

SEQ ID NO: 5037 - RNA, 20 nt, Homo Sapiens
ggcggcgcggggcgcgcggg

SEQ ID NO: 5038 - RNA, 20 nt, Homo Sapiens
ggcggcggcggcggcgaggg

SEQ ID NO: 5039 - RNA, 19 nt, Homo Sapiens
ggcggggcggcggcgaggg

SEQ ID NO: 5040 - RNA, 21 nt, Homo Sapiens
ggcggagcgggcggcggcggc

SEQ ID NO: 5041 - RNA, 21 nt, Homo Sapiens
gguggcgagggcggcgagggc

SEQ ID NO: 5042 - RNA, 20 nt, Homo Sapiens
ggcggcgcgggagcgggaca

SEQ ID NO: 5043 - RNA, 22 nt, Homo Sapiens
ggcggcgcgggcagagagcgca

SEQ ID NO: 5044 - RNA, 22 nt, Homo Sapiens
ggcggcgcgggcggcucuggca

SEQ ID NO: 5045 - RNA, 19 nt, Homo Sapiens
ggcggcgugggcgagggca

SEQ ID NO: 5046 - RNA, 22 nt, Homo Sapiens
ggcuucgcgggcggcggcggca

SEQ ID NO: 5047 - RNA, 21 nt, Homo Sapiens
gggcucgggcucgggcggcga

SEQ ID NO: 5048 - RNA, 25 nt, Homo Sapiens
gggcgucuguccgggcggcgcgggc

SEQ ID NO: 5049 - RNA, 23 nt, Homo Sapiens
gggcggcgcgacgggcggcgugg

SEQ ID NO: 5050 - RNA, 26 nt, Homo Sapiens
gggcggcgccgaggcggcguugggca

SEQ ID NO: 5051 - RNA, 23 nt, Homo Sapiens
ggggggcggcgggcggcagcggc

SEQ ID NO: 5052 - RNA, 21 nt, Homo Sapiens
gggcggcgcagggggccgagg

SEQ ID NO: 5053 - RNA, 22 nt, Homo Sapiens
gggcggcgcggggcgcagaggg

SEQ ID NO: 5054 - RNA, 23 nt, Homo Sapiens
gggcggcgcggggcggggcgggc

SEQ ID NO: 5055 - RNA, 23 nt, Homo Sapiens
gggcggcgcggagaggcgcgggc

SEQ ID NO: 5056 - RNA, 24 nt, Homo Sapiens
gggcggcgcgggccuuggcacggg

SEQ ID NO: 5057 - RNA, 24 nt, Homo Sapiens
ggacggcgcgggccaggcagcggc

SEQ ID NO: 5058 - RNA, 22 nt, Homo Sapiens
gggcggccgggccggcgagggc

SEQ ID NO: 5059 - RNA, 24 nt, Homo Sapiens
gggcggcgcgggcagcggagcggc

SEQ ID NO: 5060 - RNA, 22 nt, Homo Sapiens
ggccggcgcgggcggcucaggg

SEQ ID NO: 5061 - RNA, 18 nt, Homo Sapiens
gggcggcgcggggagagg

SEQ ID NO: 5062 - RNA, 19 nt, Homo Sapiens
gggcgugcgggcggcgagg

SEQ ID NO: 5063 - RNA, 20 nt, Homo Sapiens
gggcgggcgggcggcgcggg

SEQ ID NO: 5064 - RNA, 19 nt, Homo Sapiens
gggcggcgcggcgggaggg

SEQ ID NO: 5065 - RNA, 21 nt, Homo Sapiens
ggacggcggcgcggcgagggc

SEQ ID NO: 5066 - RNA, 22 nt, Homo Sapiens
gggcgccgcgggcggcgagggc

SEQ ID NO: 5067 - RNA, 20 nt, Homo Sapiens
gggcggcgcggggcgcgggc

SEQ ID NO: 5068 - RNA, 23 nt, Homo Sapiens
gggagccgcgggcggcgcgggca

SEQ ID NO: 5069 - RNA, 21 nt, Homo Sapiens
gggcggggcggggcgagggca

SEQ ID NO: 5070 - RNA, 20 nt, Homo Sapiens
uggagcggcggcgggcggcg

SEQ ID NO: 5071 - RNA, 25 nt, Homo Sapiens
ugggcagggcgcgggccggcgcggg

SEQ ID NO: 5072 - RNA, 24 nt, Homo Sapiens
ugcgcaggcgcgggcagugcgcgc

SEQ ID NO: 5073 - RNA, 23 nt, Homo Sapiens
ugggcaggcgggguggcgagggc

SEQ ID NO: 5074 - RNA, 26 nt, Homo Sapiens
ugggaggcuguucgggcggcggcggc

SEQ ID NO: 5075 - RNA, 22 nt, Homo Sapiens
ugggcggcgggcgugcaggggc

SEQ ID NO: 5076 - RNA, 21 nt, Homo Sapiens
uggggcgcgcgggcggcgagg

SEQ ID NO: 5077 - RNA, 22 nt, Homo Sapiens
uggggagcgcgggcggcccggg

SEQ ID NO: 5078 - RNA, 82 nt, Homo Sapiens
ggagcuggagaggugcaggcccagggcgucguccgagugagcagcggugcuggccgugugggacccgggcccgcuuagcacc

SEQ ID NO: 5079 - RNA, 24 nt, Homo Sapiens
uggccgugugggacccgggcccgc

SEQ ID NO: 5080 - RNA, 18 nt, Homo Sapiens
ccggcggggcccgggccc

SEQ ID NO: 5081 - RNA, 20 nt, Homo Sapiens
ccgcgucggagcgggcccgc

SEQ ID NO: 5082 - RNA, 24 nt, Homo Sapiens
gcccugcggaggccccgggcccgc

SEQ ID NO: 5083 - RNA, 21 nt, Homo Sapiens
gccguguggcacacaccuggc

SEQ ID NO: 5084 - RNA, 20 nt, Homo Sapiens
gccgccuccgacccgggccc

SEQ ID NO: 5085 - RNA, 20 nt, Homo Sapiens
gccguguggcaaccgugccc

SEQ ID NO: 5086 - RNA, 20 nt, Homo Sapiens
gccgcggggagccgggcccg

SEQ ID NO: 5087 - RNA, 19 nt, Homo Sapiens
ggccagggugggacccugg

SEQ ID NO: 5088 - RNA, 23 nt, Homo Sapiens
ggcuguugaggcagccgggcccg

SEQ ID NO: 5089 - RNA, 25 nt, Homo Sapiens
ggccgugacggcggcuccgggcccg

SEQ ID NO: 5090 - RNA, 26 nt, Homo Sapiens
ggccgagcggggacccggcggcucgc

SEQ ID NO: 5091 - RNA, 22 nt, Homo Sapiens
gggcuugugggugcccgggccc

SEQ ID NO: 5092 - RNA, 22 nt, Homo Sapiens
ggccgcagggaggccgggcccg

SEQ ID NO: 5093 - RNA, 23 nt, Homo Sapiens
ggccgcuucggccgccgggcccg

SEQ ID NO: 5094 - RNA, 20 nt, Homo Sapiens
gguccugugggacccccgcc

SEQ ID NO: 5095 - RNA, 19 nt, Homo Sapiens
ggcaggguggccgggcccg

SEQ ID NO: 5096 - RNA, 20 nt, Homo Sapiens
ggccgcgcggcccgggcccg

SEQ ID NO: 5097 - RNA, 21 nt, Homo Sapiens
uggccgccugagggacccggg

SEQ ID NO: 5098 - RNA, 22 nt, Homo Sapiens
uggcgcgcugggcccgggcccg

SEQ ID NO: 5099 - RNA, 18 nt, Homo Sapiens
ugggcgcggggacccggg

SEQ ID NO: 5100 - RNA, 19 nt, Homo Sapiens
uggcguuugggacccgggc

SEQ ID NO: 5101 - RNA, 20 nt, Homo Sapiens
uggccgugugcgcugcgccc

SEQ ID NO: 5102 - RNA, 21 nt, Homo Sapiens
uggccgugugaccggugcccg

SEQ ID NO: 5103 - RNA, 22 nt, Homo Sapiens
uggccguguggaccgggucugc

SEQ ID NO: 5104 - RNA, 19 nt, Homo Sapiens
ugugggaccuccgggaccg

SEQ ID NO: 5105 - RNA, 68 nt, Homo Sapiens
ggagcuggcccugggcagcaacaagcugggugaugugggcauggcggagcugugcccagggcugcucc

SEQ ID NO: 5106 - RNA, 24 nt, Homo Sapiens
uggcggagcugugcccagggcugc

SEQ ID NO: 5107 - RNA, 16 nt, Homo Sapiens
cggagcugugcgggcu

SEQ ID NO: 5108 - RNA, 21 nt, Homo Sapiens
gagcgaugcgcccagggcugc

SEQ ID NO: 5109 - RNA, 24 nt, Homo Sapiens
gcggagcugguucgcccagcguug

SEQ ID NO: 5110 - RNA, 24 nt, Homo Sapiens
gcggacaguaagagcccagggcug

SEQ ID NO: 5111 - RNA, 23 nt, Homo Sapiens
gcgcagcuggggagccagggcug

SEQ ID NO: 5112 - RNA, 19 nt, Homo Sapiens
gcggagcuggaccagagcu

SEQ ID NO: 5113 - RNA, 21 nt, Homo Sapiens
gcggagcugagcccagccugc

SEQ ID NO: 5114 - RNA, 24 nt, Homo Sapiens
ggcaggggcggugcccagggcugc

SEQ ID NO: 5115 - RNA, 22 nt, Homo Sapiens
ggcggacugcgcggugcccagg

SEQ ID NO: 5116 - RNA, 19 nt, Homo Sapiens
ggcagaccggugcccaggg

SEQ ID NO: 5117 - RNA, 20 nt, Homo Sapiens
ggcagagcugugcgcacggc

SEQ ID NO: 5118 - RNA, 26 nt, Homo Sapiens
uggcagagcaacuggcacagggcugc

SEQ ID NO: 5119 - RNA, 26 nt, Homo Sapiens
ugguagagcuacgcgcuccagggcug

SEQ ID NO: 5120 - RNA, 26 nt, Homo Sapiens
uggcggcugugggaugccagggcugc

SEQ ID NO: 5121 - RNA, 25 nt, Homo Sapiens
uggcggagccgagccugcgggcggc

SEQ ID NO: 5122 - RNA, 24 nt, Homo Sapiens
uggaagaggcgagcccagggcagc

SEQ ID NO: 5123 - RNA, 71 nt, Homo Sapiens
ggagggccaggguuuccccgggcgcggggcuuaucuuccuuugccugcuaugaaaaacauucucaccuucc

SEQ ID NO: 5124 - RNA, 24 nt, Homo Sapiens
gccugcuaugaaaaacauucucac

SEQ ID NO: 5125 - RNA, 19 nt, Homo Sapiens
ccugucucuaugaaaaaca

SEQ ID NO: 5126 - RNA, 21 nt, Homo Sapiens
ccugcuaugagaaauaauguc

SEQ ID NO: 5127 - RNA, 19 nt, Homo Sapiens
ccagcuaaaaacauucuca

SEQ ID NO: 5128 - RNA, 17 nt, Homo Sapiens
cugcuagaaaacauucu

SEQ ID NO: 5129 - RNA, 18 nt, Homo Sapiens
cuucuacagaaacauucu

SEQ ID NO: 5130 - RNA, 20 nt, Homo Sapiens
gccuguaacacaaaacauuc

SEQ ID NO: 5131 - RNA, 20 nt, Homo Sapiens
gccucuuggcgaacauucuc

SEQ ID NO: 5132 - RNA, 20 nt, Homo Sapiens
gcugugcuaaaacauucuca

SEQ ID NO: 5133 - RNA, 17 nt, Homo Sapiens
uguuauguaacauucuc

SEQ ID NO: 5134 - RNA, 20 nt, Homo Sapiens
ugauaucaaacacauucuca

SEQ ID NO: 5135 - RNA, 79 nt, Homo Sapiens
ggagggcgggggagagacgagcggcucuggccccuuaauuguacuucgggcucguauugucucuccuuucgccaccucc

SEQ ID NO: 5136 - RNA, 24 nt, Homo Sapiens
uauugucucuccuuucgccaccuc

SEQ ID NO: 5137 - RNA, 19 nt, Homo Sapiens
auugucucucuuguaguca

SEQ ID NO: 5138 - RNA, 21 nt, Homo Sapiens
gucucuccuccucgccuccuc

SEQ ID NO: 5139 - RNA, 21 nt, Homo Sapiens
gucucuccuuccucuggccac

SEQ ID NO: 5140 - RNA, 20 nt, Homo Sapiens
ucucacucagucgccaccuc

SEQ ID NO: 5141 - RNA, 21 nt, Homo Sapiens
ucucuccuuucucucacgcuc

SEQ ID NO: 5142 - RNA, 22 nt, Homo Sapiens
uugucucucuauugcuagccuc

SEQ ID NO: 5143 - RNA, 19 nt, Homo Sapiens
uugucucuccaguccccac

SEQ ID NO: 5144 - RNA, 19 nt, Homo Sapiens
uugucucucagugcccacc

SEQ ID NO: 5145 - RNA, 63 nt, Homo Sapiens
ggaggugggaggggagggccacacgaugcguugcugcgccccccgccuuccucucacuccucu

SEQ ID NO: 5146 - RNA, 24 nt, Homo Sapiens
ugggaggggagggccacacgaugc

SEQ ID NO: 5147 - RNA, 20 nt, Homo Sapiens
aggggagggucagaccaggc

SEQ ID NO: 5148 - RNA, 19 nt, Homo Sapiens
ggagggaugugggccacac

SEQ ID NO: 5149 - RNA, 23 nt, Homo Sapiens
ggagguuugggggccacacgcug

SEQ ID NO: 5150 - RNA, 21 nt, Homo Sapiens
ggcggggagggcccacaccau

SEQ ID NO: 5151 - RNA, 23 nt, Homo Sapiens
ggaggggagagcacagcgagugc

SEQ ID NO: 5152 - RNA, 23 nt, Homo Sapiens
gggagggggagggccauuagaug

SEQ ID NO: 5153 - RNA, 27 nt, Homo Sapiens
gggaggggcagggguggcacacgaugc

SEQ ID NO: 5154 - RNA, 16 nt, Homo Sapiens
gggaggggacacagga

SEQ ID NO: 5155 - RNA, 20 nt, Homo Sapiens
gggaggggaagacagcagga

SEQ ID NO: 5156 - RNA, 20 nt, Homo Sapiens
gggaggggaggacggcacga

SEQ ID NO: 5157 - RNA, 21 nt, Homo Sapiens
gggaggggaagccaacaccau

SEQ ID NO: 5158 - RNA, 20 nt, Homo Sapiens
ugggagcaggcagggccaca

SEQ ID NO: 5159 - RNA, 22 nt, Homo Sapiens
ugggagggguguuggucccaca

SEQ ID NO: 5160 - RNA, 19 nt, Homo Sapiens
ugggagggggacgccacac

SEQ ID NO: 5161 - RNA, 70 nt, Homo Sapiens
ggagucuccucucuaccgccacugucacaccguagcccacauggauagcacaguugucagacaagauucc

SEQ ID NO: 5162 - RNA, 24 nt, Homo Sapiens
uagcacaguugucagacaagauuc

SEQ ID NO: 5163 - RNA, 17 nt, Homo Sapiens
agcagcagcagacaaga

SEQ ID NO: 5164 - RNA, 19 nt, Homo Sapiens
agcacuuauuugucagaca

SEQ ID NO: 5165 - RNA, 25 nt, Homo Sapiens
agcacaguuguaaauagaaacauuc

SEQ ID NO: 5166 - RNA, 23 nt, Homo Sapiens
agcacaguucuucacaagaauuc

SEQ ID NO: 5167 - RNA, 18 nt, Homo Sapiens
agcauugagacaagauuc

SEQ ID NO: 5168 - RNA, 22 nt, Homo Sapiens
cacagcaaucaaagacaagauu

SEQ ID NO: 5169 - RNA, 19 nt, Homo Sapiens
cacaguuguuuggccagau

SEQ ID NO: 5170 - RNA, 19 nt, Homo Sapiens
cacauuugucagacgugau

SEQ ID NO: 5171 - RNA, 19 nt, Homo Sapiens
cacaguugucaacaauauu

SEQ ID NO: 5172 - RNA, 18 nt, Homo Sapiens
cagucucagacaaguuuc

SEQ ID NO: 5173 - RNA, 17 nt, Homo Sapiens
uagcacaguggcagcaa

SEQ ID NO: 5174 - RNA, 17 nt, Homo Sapiens
uagcacaguagaaaaga

SEQ ID NO: 5175 - RNA, 21 nt, Homo Sapiens
uaucacaguuguccaugcuuc

SEQ ID NO: 5176 - RNA, 61 nt, Homo Sapiens
ggauaacagcaauguucagggaacaaaggagauaacuuuaaacucugacgugccgugagcc

SEQ ID NO: 5177 - RNA, 24 nt, Homo Sapiens
uaacagcaauguucagggaacaaa

SEQ ID NO: 5178 - RNA, 19 nt, Homo Sapiens
aacagcaauauuuuaggga

SEQ ID NO: 5179 - RNA, 24 nt, Homo Sapiens
aacagaauauugguagggaacaaa

SEQ ID NO: 5180 - RNA, 21 nt, Homo Sapiens
aacagcaauggaggagaacaa

SEQ ID NO: 5181 - RNA, 19 nt, Homo Sapiens
aaaagcauucagggaagaa

SEQ ID NO: 5182 - RNA, 19 nt, Homo Sapiens
aacagcaaugagggugcaa

SEQ ID NO: 5183 - RNA, 20 nt, Homo Sapiens
aacaggaauuugggaacaaa

SEQ ID NO: 5184 - RNA, 17 nt, Homo Sapiens
acagauguucagggaac

SEQ ID NO: 5185 - RNA, 16 nt, Homo Sapiens
acagccaucagggaac

SEQ ID NO: 5186 - RNA, 19 nt, Homo Sapiens
acaggaagguucagggaac

SEQ ID NO: 5187 - RNA, 20 nt, Homo Sapiens
cagcgaaaauguucagggaa

SEQ ID NO: 5188 - RNA, 21 nt, Homo Sapiens
caggaaguugaucagggaaca

SEQ ID NO: 5189 - RNA, 22 nt, Homo Sapiens
cagcaauguugggaggaaaaaa

SEQ ID NO: 5190 - RNA, 17 nt, Homo Sapiens
cagcaauguagagagca

SEQ ID NO: 5191 - RNA, 17 nt, Homo Sapiens
gcaauggugggaacaaa

SEQ ID NO: 5192 - RNA, 24 nt, Homo Sapiens
uaaaagcaauggacaguucaggga

SEQ ID NO: 5193 - RNA, 22 nt, Homo Sapiens
uaacagcaaagcaucagcaaca

SEQ ID NO: 5194 - RNA, 23 nt, Homo Sapiens
uaacagaagguuaacagggaaca

SEQ ID NO: 5195 - RNA, 21 nt, Homo Sapiens
uaaagcacagcucagggaaca

SEQ ID NO: 5196 - RNA, 22 nt, Homo Sapiens
uaacagcaacucccagaacaaa

SEQ ID NO: 5197 - RNA, 64 nt, Homo Sapiens
ggauacaaguggggccaugccucccuggcccugacuccaggcugggguauccugaacuguaucc

SEQ ID NO: 5198 - RNA, 24 nt, Homo Sapiens
uacaaguggggccaugccucccug

SEQ ID NO: 5199 - RNA, 20 nt, Homo Sapiens
acaagcugucagccaugccu

SEQ ID NO: 5200 - RNA, 21 nt, Homo Sapiens
acaaggggccgcgccucccug

SEQ ID NO: 5201 - RNA, 20 nt, Homo Sapiens
acagguggggccacucacug

SEQ ID NO: 5202 - RNA, 22 nt, Homo Sapiens
accagugucuccugccucccug

SEQ ID NO: 5203 - RNA, 19 nt, Homo Sapiens
agugggggccauggucucc

SEQ ID NO: 5204 - RNA, 23 nt, Homo Sapiens
aguggggcccaugcugcucccug

SEQ ID NO: 5205 - RNA, 17 nt, Homo Sapiens
aguggaaggccucccug

SEQ ID NO: 5206 - RNA, 19 nt, Homo Sapiens
agugggugcagccucccug

SEQ ID NO: 5207 - RNA, 25 nt, Homo Sapiens
cagguggggccacucuuggccuccc

SEQ ID NO: 5208 - RNA, 19 nt, Homo Sapiens
cauguguggccaugccucc

SEQ ID NO: 5209 - RNA, 22 nt, Homo Sapiens
guggagcuuccaugccucccug

SEQ ID NO: 5210 - RNA, 22 nt, Homo Sapiens
guggcuccaguaagccucccug

SEQ ID NO: 5211 - RNA, 20 nt, Homo Sapiens
uaccaguggggccacgucuc

SEQ ID NO: 5212 - RNA, 20 nt, Homo Sapiens
uggaggccagggccucccug

SEQ ID NO: 5213 - RNA, 67 nt, Homo Sapiens
ggauaucaucacucagauuaaagcagcuucuggacuuuguuuugaaauguaaaagugaugaaaaucc

SEQ ID NO: 5214 - RNA, 24 nt, Homo Sapiens
uaucaucacucagauuaaagcagc

SEQ ID NO: 5215 - RNA, 21 nt, Homo Sapiens
uaucaagagccacagauuaaa

SEQ ID NO: 5216 - RNA, 25 nt, Homo Sapiens
uaucaucacugaaacgaauuagcag

SEQ ID NO: 5217 - RNA, 18 nt, Homo Sapiens
ucacucagaagcaacagc

SEQ ID NO: 5218 - RNA, 19 nt, Homo Sapiens
uccucagcucauuaaagca

SEQ ID NO: 5219 - RNA, 21 nt, Homo Sapiens
uccucacagcacuaaagcagc

SEQ ID NO: 5220 - RNA, 60 nt, Homo Sapiens
ggauauggggugcaagucgaguucgggaccacgcuuggggaagugcgccagaaacuaucc

SEQ ID NO: 5221 - RNA, 24 nt, Homo Sapiens
uauggggugcaagucgaguucggg

SEQ ID NO: 5222 - RNA, 22 nt, Homo Sapiens
aucgggugcaaggccgacucgg

SEQ ID NO: 5223 - RNA, 17 nt, Homo Sapiens
auggggugcacguguuc

SEQ ID NO: 5224 - RNA, 22 nt, Homo Sapiens
ggugccaagcacagaguucggg

SEQ ID NO: 5225 - RNA, 21 nt, Homo Sapiens
uauaaggugcaaguaaaauuc

SEQ ID NO: 5226 - RNA, 22 nt, Homo Sapiens
uaugggguggagggacuccggg

SEQ ID NO: 5227 - RNA, 20 nt, Homo Sapiens
uggggugcagagcaggguuc

SEQ ID NO: 5228 - RNA, 65 nt, Homo Sapiens
ggaugaaaacauggaccucuuggaagguauaacuggcuuugaagacucuguccgaaaguuuaucu

SEQ ID NO: 5229 - RNA, 24 nt, Homo Sapiens
ugaaaacauggaccucuuggaagg

SEQ ID NO: 5230 - RNA, 21 nt, Homo Sapiens
aaaacaugguugcucugggaa

SEQ ID NO: 5231 - RNA, 24 nt, Homo Sapiens
aaaacaugggcuucuugaugaagg

SEQ ID NO: 5232 - RNA, 19 nt, Homo Sapiens
aaaaauuugaccucuugga

SEQ ID NO: 5233 - RNA, 19 nt, Homo Sapiens
aaaaaaaggcucuuggaag

SEQ ID NO: 5234 - RNA, 20 nt, Homo Sapiens
aaacauggaggcccucuugg

SEQ ID NO: 5235 - RNA, 21 nt, Homo Sapiens
aaacauggauaaaugggaagg

SEQ ID NO: 5236 - RNA, 22 nt, Homo Sapiens
aacuauaguccuucuuggaagg

SEQ ID NO: 5237 - RNA, 18 nt, Homo Sapiens
acaguaccucuuggcagg

SEQ ID NO: 5238 - RNA, 19 nt, Homo Sapiens
cauggaacaacuuggaagg

SEQ ID NO: 5239 - RNA, 20 nt, Homo Sapiens
gaaaacaugaaggacaucuu

SEQ ID NO: 5240 - RNA, 20 nt, Homo Sapiens
gaaaacauggaaccgcgugg

SEQ ID NO: 5241 - RNA, 19 nt, Homo Sapiens
gaaaacaugacccuugaaa

SEQ ID NO: 5242 - RNA, 27 nt, Homo Sapiens
ugaaacacaaaaggaccucuuaagaag

SEQ ID NO: 5243 - RNA, 19 nt, Homo Sapiens
ugaaaacauuauccuuuug

SEQ ID NO: 5244 - RNA, 18 nt, Homo Sapiens
ugaucacauggacccuug

SEQ ID NO: 5245 - RNA, 21 nt, Homo Sapiens
ugaaaacauuaaucacaugga

SEQ ID NO: 5246 - RNA, 23 nt, Homo Sapiens
ugaaaacauugacuuuuuacaag

SEQ ID NO: 5247 - RNA, 24 nt, Homo Sapiens
ugagaucauggucuucuuggaagg

SEQ ID NO: 5248 - RNA, 85 nt, Homo Sapiens
ggauggggcagagcugagaagccaaggggggaagaguuggggcugaccucuucuucaccucgggccuuaaucacugaccaagucc

SEQ ID NO: 5249 - RNA, 24 nt, Homo Sapiens
ugagaagccaaggggggaagaguu

SEQ ID NO: 5250 - RNA, 19 nt, Homo Sapiens
aagcaggaggggaagaguu

SEQ ID NO: 5251 - RNA, 19 nt, Homo Sapiens
aaacuaaggggggaaaagu

SEQ ID NO: 5252 - RNA, 20 nt, Homo Sapiens
aaggaaauuggggaagaguu

SEQ ID NO: 5253 - RNA, 20 nt, Homo Sapiens
agaacaggccagggggaaga

SEQ ID NO: 5254 - RNA, 20 nt, Homo Sapiens
agaaggcccccaagggggga

SEQ ID NO: 5255 - RNA, 22 nt, Homo Sapiens
agaagccaaagggccugggaag

SEQ ID NO: 5256 - RNA, 21 nt, Homo Sapiens
agaagccaaacaggaggagga

SEQ ID NO: 5257 - RNA, 24 nt, Homo Sapiens
agaagccaagagagcggggaggag

SEQ ID NO: 5258 - RNA, 18 nt, Homo Sapiens
agaugcaaggggggaaga

SEQ ID NO: 5259 - RNA, 20 nt, Homo Sapiens
agaaacugaggggggaaagu

SEQ ID NO: 5260 - RNA, 21 nt, Homo Sapiens
gaugccaaaaagggggaagag

SEQ ID NO: 5261 - RNA, 19 nt, Homo Sapiens
gaagccaaggucggggcag

SEQ ID NO: 5262 - RNA, 21 nt, Homo Sapiens
gagaagccaaagcgcugggaa

SEQ ID NO: 5263 - RNA, 22 nt, Homo Sapiens
gagaagccaagcaggggaugag

SEQ ID NO: 5264 - RNA, 21 nt, Homo Sapiens
gagaagccaaaguggcaaaag

SEQ ID NO: 5265 - RNA, 21 nt, Homo Sapiens
gagaaggggagaggggaagag

SEQ ID NO: 5266 - RNA, 21 nt, Homo Sapiens
gagaggugaaagggggaagag

SEQ ID NO: 5267 - RNA, 19 nt, Homo Sapiens
gagaagccagggcagaguu

SEQ ID NO: 5268 - RNA, 22 nt, Homo Sapiens
gagaagccaaauggggaugguu

SEQ ID NO: 5269 - RNA, 19 nt, Homo Sapiens
gcgaaggaaaggggaagag

SEQ ID NO: 5270 - RNA, 25 nt, Homo Sapiens
ugagaagccccaagguggugaggag

SEQ ID NO: 5271 - RNA, 23 nt, Homo Sapiens
ugagcaggcccaagggggugaag

SEQ ID NO: 5272 - RNA, 24 nt, Homo Sapiens
ugagcugccuuaaugggggaagag

SEQ ID NO: 5273 - RNA, 25 nt, Homo Sapiens
ugagaagccagaggcagguggagag

SEQ ID NO: 5274 - RNA, 23 nt, Homo Sapiens
uggggagccgcaguggggaagag

SEQ ID NO: 5275 - RNA, 23 nt, Homo Sapiens
ugagaucccaggguggggaagag

SEQ ID NO: 5276 - RNA, 25 nt, Homo Sapiens
uggggacccgagguggggaagaguu

SEQ ID NO: 5277 - RNA, 26 nt, Homo Sapiens
ugaggggccaaggggugggagaaguu

SEQ ID NO: 5278 - RNA, 18 nt, Homo Sapiens
ugagagccaagggggaaa

SEQ ID NO: 5279 - RNA, 20 nt, Homo Sapiens
ugaacagccaagggagaaag

SEQ ID NO: 5280 - RNA, 21 nt, Homo Sapiens
ugagaagccaaaggugccaga

SEQ ID NO: 5281 - RNA, 22 nt, Homo Sapiens
ugacaggcacaugggggaagag

SEQ ID NO: 5282 - RNA, 21 nt, Homo Sapiens
ugggaagcccugggggaagag

SEQ ID NO: 5283 - RNA, 23 nt, Homo Sapiens
ugagaguccaagggggaaggcgu

SEQ ID NO: 5284 - RNA, 86 nt, Homo Sapiens
ggauguagucguucaacuaacggugacuuuuacaaaugagacggaaaaucauguaaacuguauccuuuaguuuuaucgcuguaucu

SEQ ID NO: 5285 - RNA, 24 nt, Homo Sapiens
uguaaacuguauccuuuaguuuua

SEQ ID NO: 5286 - RNA, 16 nt, Homo Sapiens
aaacugcuuuaguuuu

SEQ ID NO: 5287 - RNA, 19 nt, Homo Sapiens
aaacuguauacuuguuuua

SEQ ID NO: 5288 - RNA, 18 nt, Homo Sapiens
aaacuguauccagcuuua

SEQ ID NO: 5289 - RNA, 21 nt, Homo Sapiens
uaaacuguaaacucuuagcuu

SEQ ID NO: 5290 - RNA, 19 nt, Homo Sapiens
uaaacuguauccacaguuu

SEQ ID NO: 5291 - RNA, 21 nt, Homo Sapiens
uagacuguauccauuucuuuu

SEQ ID NO: 5292 - RNA, 26 nt, Homo Sapiens
uguaauacagaguuauccuuuauuuu

SEQ ID NO: 5293 - RNA, 19 nt, Homo Sapiens
ugucaccuguauccuguua

SEQ ID NO: 5294 - RNA, 22 nt, Homo Sapiens
uguaaacugcaauuuaguguua

SEQ ID NO: 5295 - RNA, 20 nt, Homo Sapiens
uguauccuucgggccuuuua

SEQ ID NO: 5296 - RNA, 81 nt, Homo Sapiens
ggcaaagacggccauagggugcucugaguuuugggauggucacaugacacaauccagcacuugaaccuggggccucgugcc

SEQ ID NO: 5297 - RNA, 24 nt, Homo Sapiens
uagggugcucugaguuuugggaug

SEQ ID NO: 5298 - RNA, 24 nt, Homo Sapiens
aggguagcagcugguuuugggaug

SEQ ID NO: 5299 - RNA, 20 nt, Homo Sapiens
agguugcucugagggcuggg

SEQ ID NO: 5300 - RNA, 20 nt, Homo Sapiens
aggcugcucugagcuuggga

SEQ ID NO: 5301 - RNA, 18 nt, Homo Sapiens
agggccucugaguuggga

SEQ ID NO: 5302 - RNA, 21 nt, Homo Sapiens
agagagcucugagucuggaug

SEQ ID NO: 5303 - RNA, 22 nt, Homo Sapiens
gggugggcucugagugguuggg

SEQ ID NO: 5304 - RNA, 19 nt, Homo Sapiens
gggugcucuggcugggaug

SEQ ID NO: 5305 - RNA, 18 nt, Homo Sapiens
ggugcucugccugggaug

SEQ ID NO: 5306 - RNA, 79 nt, Homo Sapiens
ggcaacuucaggaugacaaaaaccaaagucucuucugcugggaaaucccaguacagaucguuucucaucucuaagugcc

SEQ ID NO: 5307 - RNA, 24 nt, Homo Sapiens
ugacaaaaaccaaagucucuucug

SEQ ID NO: 5308 - RNA, 22 nt, Homo Sapiens
aaaaaucccauauucucuucug

SEQ ID NO: 5309 - RNA, 21 nt, Homo Sapiens
aaaaaccaacgaagucccuuc

SEQ ID NO: 5310 - RNA, 20 nt, Homo Sapiens
aaaaaccaaacguccauucu

SEQ ID NO: 5311 - RNA, 19 nt, Homo Sapiens
aaaaaccaaaauuucuccu

SEQ ID NO: 5312 - RNA, 18 nt, Homo Sapiens
aaaaaccaagcccuucug

SEQ ID NO: 5313 - RNA, 19 nt, Homo Sapiens
aaaaccaaagugcugugcu

SEQ ID NO: 5314 - RNA, 25 nt, Homo Sapiens
acagaaaaccaaauaaucaguucug

SEQ ID NO: 5315 - RNA, 21 nt, Homo Sapiens
acaugaucuauucucaucucu

SEQ ID NO: 5316 - RNA, 20 nt, Homo Sapiens
acaaaaaccacacggucucu

SEQ ID NO: 5317 - RNA, 19 nt, Homo Sapiens
acaaaaaccaauggcucuu

SEQ ID NO: 5318 - RNA, 20 nt, Homo Sapiens
acagaucuuugcucaucucu

SEQ ID NO: 5319 - RNA, 25 nt, Homo Sapiens
agcagagaucaaaguuucucauuuc

SEQ ID NO: 5320 - RNA, 20 nt, Homo Sapiens
aguacaguucaguuucucau

SEQ ID NO: 5321 - RNA, 20 nt, Homo Sapiens
caaaaugaccaaaguccuuc

SEQ ID NO: 5322 - RNA, 21 nt, Homo Sapiens
cagaaaccaaaguacucuccu

SEQ ID NO: 5323 - RNA, 20 nt, Homo Sapiens
caaagacuaaagucucugcu

SEQ ID NO: 5324 - RNA, 19 nt, Homo Sapiens
cagagugugacucaucucu

SEQ ID NO: 5325 - RNA, 20 nt, Homo Sapiens
gacaauagaccaaagucccu

SEQ ID NO: 5326 - RNA, 18 nt, Homo Sapiens
gacaaaaaccaaaucuuc

SEQ ID NO: 5327 - RNA, 21 nt, Homo Sapiens
gaaaaaaaccaaagccauucu

SEQ ID NO: 5328 - RNA, 18 nt, Homo Sapiens
guagcagacuucucaucu

SEQ ID NO: 5329 - RNA, 24 nt, Homo Sapiens
uacaagcucugguuccucaucucu

SEQ ID NO: 5330 - RNA, 23 nt, Homo Sapiens
uacagaagcggaccucaucucua

SEQ ID NO: 5331 - RNA, 20 nt, Homo Sapiens
uauaaaucuuucucauccua

SEQ ID NO: 5332 - RNA, 21 nt, Homo Sapiens
ugacaaaaaaaccaaagaucu

SEQ ID NO: 5333 - RNA, 25 nt, Homo Sapiens
ugacaaaaagcacaaaggcucauuc

SEQ ID NO: 5334 - RNA, 25 nt, Homo Sapiens
ugagaaaagcccaaagucuccccug

SEQ ID NO: 5335 - RNA, 20 nt, Homo Sapiens
ugacaaaaaaaaaggucucu

SEQ ID NO: 5336 - RNA, 21 nt, Homo Sapiens
ugaugaaaaccaaaugucuuc

SEQ ID NO: 5337 - RNA, 62 nt, Homo Sapiens
ggcacuagggacucuuugcaggguuccuuccucggaucauccaaggcugucccuacugugcc

SEQ ID NO: 5338 - RNA, 23 nt, Homo Sapiens
uccaaggcugucccuacugugcc

SEQ ID NO: 5339 - RNA, 21 nt, Homo Sapiens
aaggcugucccguccuggugc

SEQ ID NO: 5340 - RNA, 20 nt, Homo Sapiens
cagggcaggucccuacugug

SEQ ID NO: 5341 - RNA, 21 nt, Homo Sapiens
caaggcugucucgcacugggc

SEQ ID NO: 5342 - RNA, 22 nt, Homo Sapiens
ccaaucgggcuguccccugcug

SEQ ID NO: 5343 - RNA, 18 nt, Homo Sapiens
ccaaggcuguucuagcug

SEQ ID NO: 5344 - RNA, 26 nt, Homo Sapiens
uccaagguggcugucccugcccugcc

SEQ ID NO: 5345 - RNA, 21 nt, Homo Sapiens
ucccaggcaucucccuacugu

SEQ ID NO: 5346 - RNA, 17 nt, Homo Sapiens
uccaaggcuccuucugu

SEQ ID NO: 5347 - RNA, 21 nt, Homo Sapiens
ucccuggcuguccccugggcc

SEQ ID NO: 5348 - RNA, 85 nt, Homo Sapiens
ggcagagcugggcugacacagacggacugggauuggcuaaggaagaucaccuggccccuccagcccuagcccuggcucuuuuguc

SEQ ID NO: 5349 - RNA, 24 nt, Homo Sapiens
ugacacagacggacugggauuggc

SEQ ID NO: 5350 - RNA, 22 nt, Homo Sapiens
acucagaaggugagggauuggc

SEQ ID NO: 5351 - RNA, 21 nt, Homo Sapiens
acaaaagggcuggggauuggc

SEQ ID NO: 5352 - RNA, 23 nt, Homo Sapiens
cacagacaaauggcacugggauu

SEQ ID NO: 5353 - RNA, 22 nt, Homo Sapiens
cacagacggauccugcaaaugg

SEQ ID NO: 5354 - RNA, 25 nt, Homo Sapiens
gacacagacagggagcaggcauggc

SEQ ID NO: 5355 - RNA, 19 nt, Homo Sapiens
gagacagacggacgaggga

SEQ ID NO: 5356 - RNA, 21 nt, Homo Sapiens
gaccggacggacugggcuggg

SEQ ID NO: 5357 - RNA, 26 nt, Homo Sapiens
ugacacagagggcacaguggaggggc

SEQ ID NO: 5358 - RNA, 23 nt, Homo Sapiens
ugucacagacggaggggaguugg

SEQ ID NO: 5359 - RNA, 21 nt, Homo Sapiens
ugacacagaggccggaugggc

SEQ ID NO: 5360 - RNA, 67 nt, Homo Sapiens
ggcaucagaguagguauaugacuuuuuuuuuuuuuuuuuaggagagauggguccccgcucuggugcc

SEQ ID NO: 5361 - RNA, 24 nt, Homo Sapiens
ucagaguagguauaugacuuuuuu

SEQ ID NO: 5362 - RNA, 20 nt, Homo Sapiens
agagaauguuaauaugacuu

SEQ ID NO: 5363 - RNA, 22 nt, Homo Sapiens
cacaguagagaagaugacuuuu

SEQ ID NO: 5364 - RNA, 21 nt, Homo Sapiens
caaacuagguguauaugacuu

SEQ ID NO: 5365 - RNA, 20 nt, Homo Sapiens
caaauuaguaugacuuuuuu

SEQ ID NO: 5366 - RNA, 17 nt, Homo Sapiens
gaggagauaugacuuuu

SEQ ID NO: 5367 - RNA, 24 nt, Homo Sapiens
ucagaguagagauuuaugucuguu

SEQ ID NO: 5368 - RNA, 19 nt, Homo Sapiens
ucaaaguguaaugacuuuu

SEQ ID NO: 5369 - RNA, 20 nt, Homo Sapiens
ucugaguaauaugacuuauu

SEQ ID NO: 5370 - RNA, 70 nt, Homo Sapiens
ggcaucgggaagagccuaaguccacauuauaaaauaggaaguggaugcggguacaguuacucccgggacc

SEQ ID NO: 5371 - RNA, 24 nt, Homo Sapiens
ugcggguacaguuacucccgggac

SEQ ID NO: 5372 - RNA, 24 nt, Homo Sapiens
gcggguccagccgggcucccggga

SEQ ID NO: 5373 - RNA, 22 nt, Homo Sapiens
gcgagcacuuuccucccgggac

SEQ ID NO: 5374 - RNA, 21 nt, Homo Sapiens
ggguacaguaaccucagagac

SEQ ID NO: 5375 - RNA, 26 nt, Homo Sapiens
ugcaggacaguucucuuucccgggac

SEQ ID NO: 5376 - RNA, 17 nt, Homo Sapiens
uguggguacagucccgg

SEQ ID NO: 5377 - RNA, 22 nt, Homo Sapiens
uggggguccauguucccgggac

SEQ ID NO: 5378 - RNA, 23 nt, Homo Sapiens
uguggggcagcuuuucccgggac

SEQ ID NO: 5379 - RNA, 74 nt, Homo Sapiens
ggccauuguuccgcgccgauggcgagauccuuguuccucagauagcguucaucgcccgucguggucaacgggcc

SEQ ID NO: 5380 - RNA, 24 nt, Homo Sapiens
uagcguucaucgcccgucgugguc

SEQ ID NO: 5381 - RNA, 18 nt, Homo Sapiens
agcgugucaccgucgugg

SEQ ID NO: 5382 - RNA, 20 nt, Homo Sapiens
agcgcgcuggcccgucgugg

SEQ ID NO: 5383 - RNA, 23 nt, Homo Sapiens
uagcguucacggccgggcgcggu

SEQ ID NO: 5384 - RNA, 79 nt, Homo Sapiens
ggcccagcggccucuuuccuacguaccucggacugacggggcggucugacaagugccguggguugggcuucgccgggcu

SEQ ID NO: 5385 - RNA, 24 nt, Homo Sapiens
ugacaagugccguggguugggcuu

SEQ ID NO: 5386 - RNA, 19 nt, Homo Sapiens
aagugaucccuggguuggg

SEQ ID NO: 5387 - RNA, 21 nt, Homo Sapiens
aagugcagagugguugggcuu

SEQ ID NO: 5388 - RNA, 19 nt, Homo Sapiens
aagggguggggguugggcu

SEQ ID NO: 5389 - RNA, 20 nt, Homo Sapiens
aacuccccuacguugggcuu

SEQ ID NO: 5390 - RNA, 21 nt, Homo Sapiens
acaggucagccuuggguuggg

SEQ ID NO: 5391 - RNA, 21 nt, Homo Sapiens
agugccgugaugcuguugggc

SEQ ID NO: 5392 - RNA, 21 nt, Homo Sapiens
agagcccugggaguugggcuu

SEQ ID NO: 5393 - RNA, 19 nt, Homo Sapiens
agugccgugguaugaucuu

SEQ ID NO: 5394 - RNA, 19 nt, Homo Sapiens
agugccgugucuaggccuu

SEQ ID NO: 5395 - RNA, 21 nt, Homo Sapiens
gaaaaugugccaguggguugg

SEQ ID NO: 5396 - RNA, 21 nt, Homo Sapiens
gacaugaggguggguuggucu

SEQ ID NO: 5397 - RNA, 19 nt, Homo Sapiens
uggcagagugccgugaguu

SEQ ID NO: 5398 - RNA, 20 nt, Homo Sapiens
ugccaugggcaguggguugg

SEQ ID NO: 5399 - RNA, 23 nt, Homo Sapiens
ugacaagugggcuaggcugggcu

SEQ ID NO: 5400 - RNA, 23 nt, Homo Sapiens
ugacaggucaggagguugggcuu

SEQ ID NO: 5401 - RNA, 70 nt, Homo Sapiens
ggccggugaucccuccaaagaaccagaagcggguggguucacuaugagaucugaggaggcuucgugggcu

SEQ ID NO: 5402 - RNA, 24 nt, Homo Sapiens
ugagaucugaggaggcuucguggg

SEQ ID NO: 5403 - RNA, 21 nt, Homo Sapiens
agaucugagguccagaguucg

SEQ ID NO: 5404 - RNA, 20 nt, Homo Sapiens
agagcugaggaggcuucaug

SEQ ID NO: 5405 - RNA, 20 nt, Homo Sapiens
agaacuaggaggcuuguagg

SEQ ID NO: 5406 - RNA, 22 nt, Homo Sapiens
agcuguggggaggcuuccaggg

SEQ ID NO: 5407 - RNA, 19 nt, Homo Sapiens
aucugaggagguuuggggg

SEQ ID NO: 5408 - RNA, 18 nt, Homo Sapiens
auguaaggaggcuucugg

SEQ ID NO: 5409 - RNA, 20 nt, Homo Sapiens
cugacggaggcuucccgugg

SEQ ID NO: 5410 - RNA, 20 nt, Homo Sapiens
gaguagcugaggaggcuccg

SEQ ID NO: 5411 - RNA, 24 nt, Homo Sapiens
gagaucugagagcuaggcugggug

SEQ ID NO: 5412 - RNA, 25 nt, Homo Sapiens
gauuuggaggaggcugcccuguggg

SEQ ID NO: 5413 - RNA, 17 nt, Homo Sapiens
ucugaggaggucgaggg

SEQ ID NO: 5414 - RNA, 22 nt, Homo Sapiens
ugaguaaucugaaaggcuucgu

SEQ ID NO: 5415 - RNA, 17 nt, Homo Sapiens
ugagacugaggagguuc

SEQ ID NO: 5416 - RNA, 17 nt, Homo Sapiens
ugagagaggaggcuccg

SEQ ID NO: 5417 - RNA, 19 nt, Homo Sapiens
ugaaucugaggagcugugg

SEQ ID NO: 5418 - RNA, 65 nt, Homo Sapiens
ggccugggagggcaugggucaagggcguccgggaagcuggagcucuuccugcugaccuuccggcc

SEQ ID NO: 5419 - RNA, 24 nt, Homo Sapiens
ugggagggcaugggucaagggcgu

SEQ ID NO: 5420 - RNA, 19 nt, Homo Sapiens
agggcguggugucaagggc

SEQ ID NO: 5421 - RNA, 19 nt, Homo Sapiens
ggagggcauggcgaaggcg

SEQ ID NO: 5422 - RNA, 19 nt, Homo Sapiens
ggcgggcaugggaggggcg

SEQ ID NO: 5423 - RNA, 19 nt, Homo Sapiens
ggaaggugggcaagggcgu

SEQ ID NO: 5424 - RNA, 23 nt, Homo Sapiens
gggagggcaggugggggcagggc

SEQ ID NO: 5425 - RNA, 22 nt, Homo Sapiens
gggagggcaugggggcaggggc

SEQ ID NO: 5426 - RNA, 20 nt, Homo Sapiens
gggagggcaggaggagguca

SEQ ID NO: 5427 - RNA, 23 nt, Homo Sapiens
gggagggcaggcaggugaggggc

SEQ ID NO: 5428 - RNA, 23 nt, Homo Sapiens
gggagggcaugcugggcacaggc

SEQ ID NO: 5429 - RNA, 23 nt, Homo Sapiens
gggagggcaaggggcagaguggc

SEQ ID NO: 5430 - RNA, 19 nt, Homo Sapiens
ggaaagggaagggucaagg

SEQ ID NO: 5431 - RNA, 18 nt, Homo Sapiens
gggagggcagggcccagg

SEQ ID NO: 5432 - RNA, 19 nt, Homo Sapiens
gggagggcagggguggagg

SEQ ID NO: 5433 - RNA, 18 nt, Homo Sapiens
gggagggcaggccagggg

SEQ ID NO: 5434 - RNA, 20 nt, Homo Sapiens
gggagggcagggggcggggg

SEQ ID NO: 5435 - RNA, 17 nt, Homo Sapiens
gggagggcaggcagggc

SEQ ID NO: 5436 - RNA, 21 nt, Homo Sapiens
gggugggugggggucaagggc

SEQ ID NO: 5437 - RNA, 20 nt, Homo Sapiens
gggagggcagguccggggcg

SEQ ID NO: 5438 - RNA, 18 nt, Homo Sapiens
gggagggcagggcgggcg

SEQ ID NO: 5439 - RNA, 19 nt, Homo Sapiens
gggagggcaggcagggcgu

SEQ ID NO: 5440 - RNA, 23 nt, Homo Sapiens
gggugggcaugggacaggugugu

SEQ ID NO: 5441 - RNA, 18 nt, Homo Sapiens
gggcaugggcuccgggcg

SEQ ID NO: 5442 - RNA, 28 nt, Homo Sapiens
ugggagggcccugggacagggagggggu

SEQ ID NO: 5443 - RNA, 23 nt, Homo Sapiens
ugggagggcccuggguccagcgc

SEQ ID NO: 5444 - RNA, 19 nt, Homo Sapiens
ugggagggcuaaggguaag

SEQ ID NO: 5445 - RNA, 21 nt, Homo Sapiens
ugggagggcagguggagaagg

SEQ ID NO: 5446 - RNA, 21 nt, Homo Sapiens
ugggagggcugaugucagggg

SEQ ID NO: 5447 - RNA, 17 nt, Homo Sapiens
ugggagggcggggcaag

SEQ ID NO: 5448 - RNA, 19 nt, Homo Sapiens
ugggagggcugggggcaag

SEQ ID NO: 5449 - RNA, 19 nt, Homo Sapiens
ugggagggcaggggcaagg

SEQ ID NO: 5450 - RNA, 20 nt, Homo Sapiens
ugggagggcauggaugacgg

SEQ ID NO: 5451 - RNA, 21 nt, Homo Sapiens
ugggagggcgcggggcgcggg

SEQ ID NO: 5452 - RNA, 19 nt, Homo Sapiens
ugggagggcaggacagggc

SEQ ID NO: 5453 - RNA, 22 nt, Homo Sapiens
ugggagggcagggacccaaggc

SEQ ID NO: 5454 - RNA, 22 nt, Homo Sapiens
ugggagggccuggcacccgggc

SEQ ID NO: 5455 - RNA, 22 nt, Homo Sapiens
uggggugugaugggucaaaggc

SEQ ID NO: 5456 - RNA, 20 nt, Homo Sapiens
ugggugggcaugggcagggc

SEQ ID NO: 5457 - RNA, 19 nt, Homo Sapiens
ugggagggcugggugggcg

SEQ ID NO: 5458 - RNA, 22 nt, Homo Sapiens
ugggacccauggccaagggcgu

SEQ ID NO: 5459 - RNA, 60 nt, Homo Sapiens
ggcgagcgacagccccugcugggucccccugaguccaugcgggaacauguggucgcugcc

SEQ ID NO: 5460 - RNA, 23 nt, Homo Sapiens
ugcgggaacauguggucgcugcc

SEQ ID NO: 5461 - RNA, 21 nt, Homo Sapiens
cggaaacauguggaugccgcc

SEQ ID NO: 5462 - RNA, 18 nt, Homo Sapiens
gccgguacgguggucgcu

SEQ ID NO: 5463 - RNA, 20 nt, Homo Sapiens
gcgggaacagaggugccugc

SEQ ID NO: 5464 - RNA, 20 nt, Homo Sapiens
ggacacuugaggucgcugcc

SEQ ID NO: 5465 - RNA, 18 nt, Homo Sapiens
gggaacauggucugugcc

SEQ ID NO: 5466 - RNA, 20 nt, Homo Sapiens
gggaacaugugaugggggcc

SEQ ID NO: 5467 - RNA, 24 nt, Homo Sapiens
ugaggcaacuggugagucgcugcc

SEQ ID NO: 5468 - RNA, 17 nt, Homo Sapiens
ugagggcuuguggucgc

SEQ ID NO: 5469 - RNA, 60 nt, Homo Sapiens
ggcggggccgggggcccggggagcggccuggcuacgcugcccgggcucccgcccucagcc

SEQ ID NO: 5470 - RNA, 23 nt, Homo Sapiens
ugcccgggcucccgcccucagcc

SEQ ID NO: 5471 - RNA, 23 nt, Homo Sapiens
cccgaaggcccccgcccuccgcc

SEQ ID NO: 5472 - RNA, 22 nt, Homo Sapiens
cccguggccucccgccccaccc

SEQ ID NO: 5473 - RNA, 19 nt, Homo Sapiens
cccgggcuccccgcuccuc

SEQ ID NO: 5474 - RNA, 20 nt, Homo Sapiens
cccgggcucugcauccgccc

SEQ ID NO: 5475 - RNA, 22 nt, Homo Sapiens
cccggccccuccgcccucagcc

SEQ ID NO: 5476 - RNA, 22 nt, Homo Sapiens
cccgggcucgccgcgagcagcc

SEQ ID NO: 5477 - RNA, 23 nt, Homo Sapiens
cccgggcuccugcgcgcucagcc

SEQ ID NO: 5478 - RNA, 21 nt, Homo Sapiens
cccgggcuccugacccucggc

SEQ ID NO: 5479 - RNA, 22 nt, Homo Sapiens
cccgggcucccccgccccggcc

SEQ ID NO: 5480 - RNA, 20 nt, Homo Sapiens
cccgggcuccccaugcagcc

SEQ ID NO: 5481 - RNA, 22 nt, Homo Sapiens
ccgggcucccugcgcccacagc

SEQ ID NO: 5482 - RNA, 19 nt, Homo Sapiens
ccgagcucccgccgccuca

SEQ ID NO: 5483 - RNA, 21 nt, Homo Sapiens
cccggcucccgcguccucagc

SEQ ID NO: 5484 - RNA, 20 nt, Homo Sapiens
ccgggcccuggcccucagcc

SEQ ID NO: 5485 - RNA, 19 nt, Homo Sapiens
ccgggcucccagcucagcc

SEQ ID NO: 5486 - RNA, 20 nt, Homo Sapiens
ccuggcucccgcccgccgcc

SEQ ID NO: 5487 - RNA, 20 nt, Homo Sapiens
cgggucucccgcccgccgcc

SEQ ID NO: 5488 - RNA, 19 nt, Homo Sapiens
cgggcucccggccgcagcc

SEQ ID NO: 5489 - RNA, 25 nt, Homo Sapiens
gcucggcgcucacacgcccucagcc

SEQ ID NO: 5490 - RNA, 22 nt, Homo Sapiens
gcccuggccucaccccucagcc

SEQ ID NO: 5491 - RNA, 20 nt, Homo Sapiens
gcccgggcugccugcccaca

SEQ ID NO: 5492 - RNA, 19 nt, Homo Sapiens
gcccgggcuccggcgcccu

SEQ ID NO: 5493 - RNA, 24 nt, Homo Sapiens
gcccgggcugagggccugcaugcc

SEQ ID NO: 5494 - RNA, 20 nt, Homo Sapiens
gcccuggcccugcccucagc

SEQ ID NO: 5495 - RNA, 21 nt, Homo Sapiens
gccgcggcucccgccccccgc

SEQ ID NO: 5496 - RNA, 22 nt, Homo Sapiens
gcccggccucccgcccgcugcc

SEQ ID NO: 5497 - RNA, 22 nt, Homo Sapiens
gccugagccaccgcccucaacc

SEQ ID NO: 5498 - RNA, 25 nt, Homo Sapiens
ugcccuggggcucccggacccggcc

SEQ ID NO: 5499 - RNA, 20 nt, Homo Sapiens
uguccgcggcucccgcucuc

SEQ ID NO: 5500 - RNA, 28 nt, Homo Sapiens
ugccuggcuagcucggccgcccucaacc

SEQ ID NO: 5501 - RNA, 21 nt, Homo Sapiens
ugcccgggccucccgcaccag

SEQ ID NO: 5502 - RNA, 24 nt, Homo Sapiens
ugcccgggcgccuccgcccgcugc

SEQ ID NO: 5503 - RNA, 24 nt, Homo Sapiens
uggccgggcucccacggcuccagc

SEQ ID NO: 5504 - RNA, 24 nt, Homo Sapiens
ugcccucccucccaccccucagcc

SEQ ID NO: 5505 - RNA, 22 nt, Homo Sapiens
ugcccgggcaaccguccccagc

SEQ ID NO: 5506 - RNA, 22 nt, Homo Sapiens
ugccugcucugcagcccucagc

SEQ ID NO: 5507 - RNA, 74 nt, Homo Sapiens
ggcucaaugaaaugaaagugaaaagaaccugacuuuacuucaucuuucuuuugauuaacuugugaucuugagcc

SEQ ID NO: 5508 - RNA, 24 nt, Homo Sapiens
ugaaaugaaagugaaaagaaccug

SEQ ID NO: 5509 - RNA, 21 nt, Homo Sapiens
augaauuucaagaagaaccug

SEQ ID NO: 5510 - RNA, 20 nt, Homo Sapiens
gaagaagagaggaaaagaac

SEQ ID NO: 5511 - RNA, 18 nt, Homo Sapiens
ugaaaugaacagaaagaa

SEQ ID NO: 5512 - RNA, 20 nt, Homo Sapiens
ugaugugaaagugagcaaag

SEQ ID NO: 5513 - RNA, 21 nt, Homo Sapiens
uggaauuagaaaaagaaccug

SEQ ID NO: 5514 - RNA, 70 nt, Homo Sapiens
ggcucugcuccucacauugccaguuaaucuucgugugacuacaguaccuggaaaaacggggacagcagcc

SEQ ID NO: 5515 - RNA, 24 nt, Homo Sapiens
uacaguaccuggaaaaacggggac

SEQ ID NO: 5516 - RNA, 25 nt, Homo Sapiens
acaguuauccuggaaaaugcgugga

SEQ ID NO: 5517 - RNA, 21 nt, Homo Sapiens
acagcaugaacaaacggggac

SEQ ID NO: 5518 - RNA, 21 nt, Homo Sapiens
aguaccugggacuacaggcac

SEQ ID NO: 5519 - RNA, 21 nt, Homo Sapiens
caguaccugggaaaaggggac

SEQ ID NO: 5520 - RNA, 21 nt, Homo Sapiens
guagcugaggcgaaacgggga

SEQ ID NO: 5521 - RNA, 20 nt, Homo Sapiens
guaauuggaaaaacauggac

SEQ ID NO: 5522 - RNA, 62 nt, Homo Sapiens
ggcugacagggaccgccggccgccccggcuccgcuuugccggcagugaguccgcugucuucc

SEQ ID NO: 5523 - RNA, 24 nt, Homo Sapiens
ugacagggaccgccggccgccccg

SEQ ID NO: 5524 - RNA, 25 nt, Homo Sapiens
acagggaccgccgggcugcagcccc

SEQ ID NO: 5525 - RNA, 21 nt, Homo Sapiens
caggggcuggccggccgcucc

SEQ ID NO: 5526 - RNA, 19 nt, Homo Sapiens
caggcagggccggccgccc

SEQ ID NO: 5527 - RNA, 17 nt, Homo Sapiens
cagggcugcggccgccc

SEQ ID NO: 5528 - RNA, 17 nt, Homo Sapiens
cagggaccgcugggccc

SEQ ID NO: 5529 - RNA, 19 nt, Homo Sapiens
cagagccgccggcccuccc

SEQ ID NO: 5530 - RNA, 22 nt, Homo Sapiens
gacaagcgccuaggccgccccg

SEQ ID NO: 5531 - RNA, 23 nt, Homo Sapiens
gacaaggcgccuaggccgccccg

SEQ ID NO: 5532 - RNA, 18 nt, Homo Sapiens
gacagggacacggccccc

SEQ ID NO: 5533 - RNA, 21 nt, Homo Sapiens
gacagggaccaucuguccccc

SEQ ID NO: 5534 - RNA, 21 nt, Homo Sapiens
gacaggugggccggccgcucc

SEQ ID NO: 5535 - RNA, 20 nt, Homo Sapiens
gagagggugcuggccgcccc

SEQ ID NO: 5536 - RNA, 20 nt, Homo Sapiens
gggagucgccggccgugccg

SEQ ID NO: 5537 - RNA, 18 nt, Homo Sapiens
gggaugcaggccgccccg

SEQ ID NO: 5538 - RNA, 19 nt, Homo Sapiens
ugacagggacagcaggacg

SEQ ID NO: 5539 - RNA, 21 nt, Homo Sapiens
ugacagggagcgccacugccc

SEQ ID NO: 5540 - RNA, 23 nt, Homo Sapiens
uggcagggucugcaggccgcccc

SEQ ID NO: 5541 - RNA, 66 nt, Homo Sapiens
gggaacuuaggaagugagaagucagauuacccuaguccucuagggugcuuaaagcuaacuaguccc

SEQ ID NO: 5542 - RNA, 24 nt, Homo Sapiens
uaggaagugagaagucagauuacc

SEQ ID NO: 5543 - RNA, 22 nt, Homo Sapiens
aaguagagauguacagauuacc

SEQ ID NO: 5544 - RNA, 19 nt, Homo Sapiens
aagugagaauugucagcuu

SEQ ID NO: 5545 - RNA, 19 nt, Homo Sapiens
aggagagucaagaagucag

SEQ ID NO: 5546 - RNA, 21 nt, Homo Sapiens
aggaaccaguggagaagucag

SEQ ID NO: 5547 - RNA, 24 nt, Homo Sapiens
aggacugucagcaaaucagauuac

SEQ ID NO: 5548 - RNA, 22 nt, Homo Sapiens
aggaggcugagaagucgagguu

SEQ ID NO: 5549 - RNA, 21 nt, Homo Sapiens
aggaagugaggagcacaguua

SEQ ID NO: 5550 - RNA, 21 nt, Homo Sapiens
aggaagugagcagugccauua

SEQ ID NO: 5551 - RNA, 19 nt, Homo Sapiens
agugagaaguagcaagauu

SEQ ID NO: 5552 - RNA, 22 nt, Homo Sapiens
gaugggagaagucagaauugcc

SEQ ID NO: 5553 - RNA, 23 nt, Homo Sapiens
gaagugagaggacaaacucuacc

SEQ ID NO: 5554 - RNA, 19 nt, Homo Sapiens
ggacaguugggaagucaga

SEQ ID NO: 5555 - RNA, 22 nt, Homo Sapiens
uaguaacuggagcucagauuac

SEQ ID NO: 5556 - RNA, 72 nt, Homo Sapiens
gggaaugauagcauugaaggacucggggauaucuaacagcaauaccugaucacuacuucgcacuaguuucuc

SEQ ID NO: 5557 - RNA, 23 nt, Homo Sapiens
ucacuacuucgcacuaguuucuc

SEQ ID NO: 5558 - RNA, 20 nt, Homo Sapiens
aaggauagcauucagcagga

SEQ ID NO: 5559 - RNA, 22 nt, Homo Sapiens
augucagcucugcaaggacucg

SEQ ID NO: 5560 - RNA, 20 nt, Homo Sapiens
cacuacuucucuagacucuc

SEQ ID NO: 5561 - RNA, 22 nt, Homo Sapiens
gaaagcacuugaaggacacggg

SEQ ID NO: 5562 - RNA, 21 nt, Homo Sapiens
gagagcagucccaggacucgg

SEQ ID NO: 5563 - RNA, 19 nt, Homo Sapiens
gaugcuagagggacucggg

SEQ ID NO: 5564 - RNA, 22 nt, Homo Sapiens
uagcauugaagagcaagacucg

SEQ ID NO: 5565 - RNA, 18 nt, Homo Sapiens
ugauagcauugcauacuc

SEQ ID NO: 5566 - RNA, 76 nt, Homo Sapiens
gggagaauccccuaagcuccagggcccagggucuaaccugagaggucggggcugcaggaagcugggggaggcuccc

SEQ ID NO: 5567 - RNA, 24 nt, Homo Sapiens
uccccuaagcuccagggcccaggg

SEQ ID NO: 5568 - RNA, 20 nt, Homo Sapiens
aaccuccagcugggcccagg

SEQ ID NO: 5569 - RNA, 20 nt, Homo Sapiens
cccccaagcuccagcagccc

SEQ ID NO: 5570 - RNA, 22 nt, Homo Sapiens
ccuucagcuccagggccgaggg

SEQ ID NO: 5571 - RNA, 23 nt, Homo Sapiens
ccugaagcuccagagggccgggg

SEQ ID NO: 5572 - RNA, 17 nt, Homo Sapiens
ccuaagcuccggcgcag

SEQ ID NO: 5573 - RNA, 20 nt, Homo Sapiens
ccuaagcuccggccucacgg

SEQ ID NO: 5574 - RNA, 20 nt, Homo Sapiens
cucagcuccaggcacccagg

SEQ ID NO: 5575 - RNA, 25 nt, Homo Sapiens
uccuccucacuccagggcgcccggg

SEQ ID NO: 5576 - RNA, 24 nt, Homo Sapiens
uccccccagcuccaggcuccccgg

SEQ ID NO: 5577 - RNA, 60 nt, Homo Sapiens
gggagggucacuugagcccaggaauugugagaucaacugggcauauagggagauccuguc

SEQ ID NO: 5578 - RNA, 24 nt, Homo Sapiens
ucaacugggcauauagggagaucc

SEQ ID NO: 5579 - RNA, 18 nt, Homo Sapiens
aacugggcaacaggguga

SEQ ID NO: 5580 - RNA, 20 nt, Homo Sapiens
aacugggcauuugggaaaau

SEQ ID NO: 5581 - RNA, 21 nt, Homo Sapiens
acugggcauuaaaugaagauc

SEQ ID NO: 5582 - RNA, 20 nt, Homo Sapiens
acugucaugcagggagaucc

SEQ ID NO: 5583 - RNA, 19 nt, Homo Sapiens
caacugggccuaaaaggga

SEQ ID NO: 5584 - RNA, 20 nt, Homo Sapiens
caaugggcagggggagaucc

SEQ ID NO: 5585 - RNA, 22 nt, Homo Sapiens
cagcugggcauaugacacaucc

SEQ ID NO: 5586 - RNA, 22 nt, Homo Sapiens
cacuugagcccagguguuggag

SEQ ID NO: 5587 - RNA, 23 nt, Homo Sapiens
cugggaucaagauagggagaccc

SEQ ID NO: 5588 - RNA, 20 nt, Homo Sapiens
cugaggaguaugggagaucc

SEQ ID NO: 5589 - RNA, 21 nt, Homo Sapiens
cugggcaacauagggagaccc

SEQ ID NO: 5590 - RNA, 20 nt, Homo Sapiens
cuuccgcccagggaauugug

SEQ ID NO: 5591 - RNA, 21 nt, Homo Sapiens
cuuaagcccaggaaucugaga

SEQ ID NO: 5592 - RNA, 20 nt, Homo Sapiens
cuugagcccagaagagguga

SEQ ID NO: 5593 - RNA, 20 nt, Homo Sapiens
cuugagcccaggagguugag

SEQ ID NO: 5594 - RNA, 20 nt, Homo Sapiens
cuugagcccaggaguuggag

SEQ ID NO: 5595 - RNA, 23 nt, Homo Sapiens
ucaacugggacuuuaauagguag

SEQ ID NO: 5596 - RNA, 23 nt, Homo Sapiens
ucaacugggcaguguggcacauc

SEQ ID NO: 5597 - RNA, 19 nt, Homo Sapiens
ucaacugggaucaugcgga

SEQ ID NO: 5598 - RNA, 20 nt, Homo Sapiens
ucaacugggcagacaaggga

SEQ ID NO: 5599 - RNA, 22 nt, Homo Sapiens
ucaacugggauaaggaaagucc

SEQ ID NO: 5600 - RNA, 23 nt, Homo Sapiens
ucaacuggggaaaaggaugaacc

SEQ ID NO: 5601 - RNA, 19 nt, Homo Sapiens
ucacuugagaucaggaguu

SEQ ID NO: 5602 - RNA, 19 nt, Homo Sapiens
ucacuugagcccaggaguu

SEQ ID NO: 5603 - RNA, 19 nt, Homo Sapiens
ucacuugaggucaggaauu

SEQ ID NO: 5604 - RNA, 19 nt, Homo Sapiens
ucacuugaggucgggaguu

SEQ ID NO: 5605 - RNA, 20 nt, Homo Sapiens
ucacuugaggccaagaguug

SEQ ID NO: 5606 - RNA, 23 nt, Homo Sapiens
ucacuggagcccaggaguuugag

SEQ ID NO: 5607 - RNA, 23 nt, Homo Sapiens
ucacuugaggucaggaguuugag

SEQ ID NO: 5608 - RNA, 23 nt, Homo Sapiens
ucgcuugagcccaggaguuugag

SEQ ID NO: 5609 - RNA, 68 nt, Homo Sapiens
gggagugaaauuuuccucucuuccccugcacauuaggaaggguaucagagggguugguguacauuccc

SEQ ID NO: 5610 - RNA, 24 nt, Homo Sapiens
aucagagggguugguguacauucc

SEQ ID NO: 5611 - RNA, 20 nt, Homo Sapiens
agagggguuggcgagauccc

SEQ ID NO: 5612 - RNA, 19 nt, Homo Sapiens
aucagaggggucauggagu

SEQ ID NO: 5613 - RNA, 23 nt, Homo Sapiens
auuacagugguucauguacauuc

SEQ ID NO: 5614 - RNA, 19 nt, Homo Sapiens
cagaggggucuguggaaau

SEQ ID NO: 5615 - RNA, 18 nt, Homo Sapiens
cagaggggugggggucau

SEQ ID NO: 5616 - RNA, 19 nt, Homo Sapiens
ucagaggucuguguacauu

SEQ ID NO: 5617 - RNA, 93 nt, Homo Sapiens
gggaguggacgccgcuggcaggauggugcuggagagcguggcccguaucgugaaggugcagcucccugcauaucugaagcggcucccaguccc

SEQ ID NO: 5618 - RNA, 24 nt, Homo Sapiens
uggcaggauggugcuggagagcgu

SEQ ID NO: 5619 - RNA, 18 nt, Homo Sapiens
caggauggucucgagugc

SEQ ID NO: 5620 - RNA, 20 nt, Homo Sapiens
cauguuggugcugggaagcg

SEQ ID NO: 5621 - RNA, 21 nt, Homo Sapiens
caggaugguugagguaagcgu

SEQ ID NO: 5622 - RNA, 23 nt, Homo Sapiens
gcgggacggugcuggaagaugcg

SEQ ID NO: 5623 - RNA, 19 nt, Homo Sapiens
ggcaggaugcagugcagga

SEQ ID NO: 5624 - RNA, 19 nt, Homo Sapiens
ggaaggaugguguguggag

SEQ ID NO: 5625 - RNA, 19 nt, Homo Sapiens
ggcaggauguugucuggag

SEQ ID NO: 5626 - RNA, 19 nt, Homo Sapiens
ggcaggaugcgcugaagag

SEQ ID NO: 5627 - RNA, 25 nt, Homo Sapiens
uggcaggaugcgucuggcugugcgu

SEQ ID NO: 5628 - RNA, 18 nt, Homo Sapiens
uggcggauggugcuggag

SEQ ID NO: 5629 - RNA, 17 nt, Homo Sapiens
uggcuggggugcuggag

SEQ ID NO: 5630 - RNA, 21 nt, Homo Sapiens
uggcaggauggucaugaaagc

SEQ ID NO: 5631 - RNA, 95 nt, Homo Sapiens
gggauguccugcuccaauacccgcacugcucuggaguauugcccucuuucccaaggagaugcugcugguggagcugguaugggugcggucuuccc

SEQ ID NO: 5632 - RNA, 24 nt, Homo Sapiens
uacccgcacugcucuggaguauug

SEQ ID NO: 5633 - RNA, 23 nt, Homo Sapiens
acccgcacuggcgcucacgagua

SEQ ID NO: 5634 - RNA, 21 nt, Homo Sapiens
acccgagcuccgucuggagua

SEQ ID NO: 5635 - RNA, 21 nt, Homo Sapiens
cugcucugguuggcaguauug

SEQ ID NO: 5636 - RNA, 19 nt, Homo Sapiens
gcaucugcucuggugucuu

SEQ ID NO: 5637 - RNA, 19 nt, Homo Sapiens
gcacugcucaggaugucuu

SEQ ID NO: 5638 - RNA, 25 nt, Homo Sapiens
uaccuugcgcugcaaaggaguauug

SEQ ID NO: 5639 - RNA, 66 nt, Homo Sapiens
gggauuacaggcguugagucaccgugcccggccaguacccacuucucuuaaugcucuaugaguucc

SEQ ID NO: 5640 - RNA, 24 nt, Homo Sapiens
uuacaggcguugagucaccgugcc

SEQ ID NO: 5641 - RNA, 17 nt, Homo Sapiens
acaggaaugucaccgug

SEQ ID NO: 5642 - RNA, 18 nt, Homo Sapiens
acacgcgggucaccgugc

SEQ ID NO: 5643 - RNA, 19 nt, Homo Sapiens
uacaccguugaguccugug

SEQ ID NO: 5644 - RNA, 22 nt, Homo Sapiens
uacaggcgugagcuacugugcc

SEQ ID NO: 5645 - RNA, 21 nt, Homo Sapiens
uuacaggugugggagucaccg

SEQ ID NO: 5646 - RNA, 22 nt, Homo Sapiens
uuacaggcgaguccaccaugcc

SEQ ID NO: 5647 - RNA, 19 nt, Homo Sapiens
uuacaggcgugauccaccg

SEQ ID NO: 5648 - RNA, 21 nt, Homo Sapiens
uuacaggcgugagccaccgug

SEQ ID NO: 5649 - RNA, 21 nt, Homo Sapiens
uuacaggcgugagucacugug

SEQ ID NO: 5650 - RNA, 23 nt, Homo Sapiens
uuacaggcaugagccaccgugcc

SEQ ID NO: 5651 - RNA, 23 nt, Homo Sapiens
uuacaggcaugggccaccgugcc

SEQ ID NO: 5652 - RNA, 23 nt, Homo Sapiens
uuacaggcgugagccaccaugcc

SEQ ID NO: 5653 - RNA, 23 nt, Homo Sapiens
uuacaggcgugagccaccgcgcc

SEQ ID NO: 5654 - RNA, 23 nt, Homo Sapiens
uuacaggcgugagccacugugcc

SEQ ID NO: 5655 - RNA, 23 nt, Homo Sapiens
uuacaggcgugagccgccgugcc

SEQ ID NO: 5656 - RNA, 23 nt, Homo Sapiens
uuacaggcgugagccaccgugcc

SEQ ID NO: 5657 - RNA, 23 nt, Homo Sapiens
uuacaggugugagccaccgugcc

SEQ ID NO: 5658 - RNA, 23 nt, Homo Sapiens
uuauaggcgugagucaccgcgcc

SEQ ID NO: 5659 - RNA, 23 nt, Homo Sapiens
uuauaggugugagccaccgugcc

SEQ ID NO: 5660 - RNA, 128 nt, Homo Sapiens
gggcaggugccuggucaaucaguccucgggauggcagccaucaacccgugggccuccuggggugaccuuacggaccaaucuugggggaugaaagcuguugacccaugggccuccugggcucugugucc

SEQ ID NO: 5661 - RNA, 24 nt, Homo Sapiens
uggcagccaucaacccgugggccu

SEQ ID NO: 5662 - RNA, 19 nt, Homo Sapiens
agccccgaaccgugggccu

SEQ ID NO: 5663 - RNA, 21 nt, Homo Sapiens
cagccaucaucacccggaggc

SEQ ID NO: 5664 - RNA, 18 nt, Homo Sapiens
cagccaucacucggggcc

SEQ ID NO: 5665 - RNA, 21 nt, Homo Sapiens
gcagccaucauucaccgaggg

SEQ ID NO: 5666 - RNA, 20 nt, Homo Sapiens
gcagccaucuagccccgugg

SEQ ID NO: 5667 - RNA, 22 nt, Homo Sapiens
ggccgcgccuccucgugggccu

SEQ ID NO: 5668 - RNA, 23 nt, Homo Sapiens
ggcagccaucagaaccuucgccu

SEQ ID NO: 5669 - RNA, 22 nt, Homo Sapiens
ggcgcccaucaacccaucgccc

SEQ ID NO: 5670 - RNA, 23 nt, Homo Sapiens
ugucaugccaucaacacccaggg

SEQ ID NO: 5671 - RNA, 27 nt, Homo Sapiens
uggcagccaccagagucccguggggcu

SEQ ID NO: 5672 - RNA, 24 nt, Homo Sapiens
ugccagcgcccacacccgugggcc

SEQ ID NO: 5673 - RNA, 25 nt, Homo Sapiens
uggccgccggccuccucgugggccu

SEQ ID NO: 5674 - RNA, 20 nt, Homo Sapiens
uggcagccauuaaguggccc

SEQ ID NO: 5675 - RNA, 24 nt, Homo Sapiens
ugggugcccucaccacgugggccu

SEQ ID NO: 5676 - RNA, 60 nt, Homo Sapiens
gggccaaagagcagcaccagaacgcuguggggaagagcagcugggugcucgccagggccc

SEQ ID NO: 5677 - RNA, 21 nt, Homo Sapiens
gcugggugcucgccagggccc

SEQ ID NO: 5678 - RNA, 22 nt, Homo Sapiens
cuuggggcgucugccagggccc

SEQ ID NO: 5679 - RNA, 20 nt, Homo Sapiens
cugggugcucuaugccaagg

SEQ ID NO: 5680 - RNA, 18 nt, Homo Sapiens
cugggugcucccggcggc

SEQ ID NO: 5681 - RNA, 19 nt, Homo Sapiens
cugggugcugccuggagcc

SEQ ID NO: 5682 - RNA, 17 nt, Homo Sapiens
cugggugcuggccggcc

SEQ ID NO: 5683 - RNA, 18 nt, Homo Sapiens
cuggcuuggccagggccc

SEQ ID NO: 5684 - RNA, 20 nt, Homo Sapiens
cugggugcucccccagcccc

SEQ ID NO: 5685 - RNA, 21 nt, Homo Sapiens
gcuggggcaccugcucgccag

SEQ ID NO: 5686 - RNA, 21 nt, Homo Sapiens
gcuggugcugcuccagggccc

SEQ ID NO: 5687 - RNA, 25 nt, Homo Sapiens
gcugggugcucaaaccacaugggcc

SEQ ID NO: 5688 - RNA, 20 nt, Homo Sapiens
gcugggugcccaggccaggg

SEQ ID NO: 5689 - RNA, 21 nt, Homo Sapiens
gcuggggcgcggccagggccc

SEQ ID NO: 5690 - RNA, 22 nt, Homo Sapiens
gcugggugcuggcugaggagcc

SEQ ID NO: 5691 - RNA, 19 nt, Homo Sapiens
gcugggcccacgccagggc

SEQ ID NO: 5692 - RNA, 19 nt, Homo Sapiens
gcugggugccgggcugggc

SEQ ID NO: 5693 - RNA, 18 nt, Homo Sapiens
gcugggugcugcuggggc

SEQ ID NO: 5694 - RNA, 20 nt, Homo Sapiens
gcagggugcucgccauugcc

SEQ ID NO: 5695 - RNA, 20 nt, Homo Sapiens
gcugagcucuggccagggcc

SEQ ID NO: 5696 - RNA, 18 nt, Homo Sapiens
gcaggguccccagggccc

SEQ ID NO: 5697 - RNA, 21 nt, Homo Sapiens
gcugggugcgacucggggccc

SEQ ID NO: 5698 - RNA, 21 nt, Homo Sapiens
gcugggugcgccccggcuccc

SEQ ID NO: 5699 - RNA, 21 nt, Homo Sapiens
gggugcucgcuggcaaggccc

SEQ ID NO: 5700 - RNA, 19 nt, Homo Sapiens
gggugcucgccuggcgccc

SEQ ID NO: 5701 - RNA, 20 nt, Homo Sapiens
ugggugcuccuaggcagggc

SEQ ID NO: 5702 - RNA, 19 nt, Homo Sapiens
uggcucauccccagggccc

SEQ ID NO: 5703 - RNA, 67 nt, Homo Sapiens
gggcccugagauggggucugaccucaguuccugcggggaacuucaccagugaccccagucagugccc

SEQ ID NO: 5704 - RNA, 24 nt, Homo Sapiens
ugagauggggucugaccucaguuc

SEQ ID NO: 5705 - RNA, 20 nt, Homo Sapiens
agguggggccucugaccuca

SEQ ID NO: 5706 - RNA, 19 nt, Homo Sapiens
agaugcuucugaccucagu

SEQ ID NO: 5707 - RNA, 19 nt, Homo Sapiens
gagauggggucuccccaca

SEQ ID NO: 5708 - RNA, 18 nt, Homo Sapiens
gagaugggucugacccag

SEQ ID NO: 5709 - RNA, 19 nt, Homo Sapiens
gagaugggucugaccccag

SEQ ID NO: 5710 - RNA, 20 nt, Homo Sapiens
gagauggggcacggccgcag

SEQ ID NO: 5711 - RNA, 21 nt, Homo Sapiens
gagaugggguuucaccacguu

SEQ ID NO: 5712 - RNA, 21 nt, Homo Sapiens
ugagacugaguggucugaccu

SEQ ID NO: 5713 - RNA, 22 nt, Homo Sapiens
ugagagugggggucugagcuca

SEQ ID NO: 5714 - RNA, 22 nt, Homo Sapiens
ugagaugggugacucugaaccu

SEQ ID NO: 5715 - RNA, 18 nt, Homo Sapiens
ugagaugugcugaccuca

SEQ ID NO: 5716 - RNA, 23 nt, Homo Sapiens
ugaggggggucugagcccacuuc

SEQ ID NO: 5717 - RNA, 20 nt, Homo Sapiens
ugggguuuggggaccucagu

SEQ ID NO: 5718 - RNA, 20 nt, Homo Sapiens
uggggucugccacugagcuc

SEQ ID NO: 5719 - RNA, 101 nt, Homo Sapiens
gggcgagcucgguggugacgcgcggcccucacgugacccagagcugcagagcgacgcagccuucggugcagucgucacucgcgucuggcuaccagcucccc

SEQ ID NO: 5720 - RNA, 24 nt, Homo Sapiens
cggugcagucgucacucgcgucug

SEQ ID NO: 5721 - RNA, 19 nt, Homo Sapiens
agucgucacuguccucguc

SEQ ID NO: 5722 - RNA, 23 nt, Homo Sapiens
cggaugcagucgucacccacauc

SEQ ID NO: 5723 - RNA, 19 nt, Homo Sapiens
cgggccuucugucacucgc

SEQ ID NO: 5724 - RNA, 25 nt, Homo Sapiens
cggugcaggggagacuacucgcguc

SEQ ID NO: 5725 - RNA, 16 nt, Homo Sapiens
cggugcagucacucgc

SEQ ID NO: 5726 - RNA, 22 nt, Homo Sapiens
gcagucgucaggcaggcguuug

SEQ ID NO: 5727 - RNA, 23 nt, Homo Sapiens
ggugcagucucggcccggcucug

SEQ ID NO: 5728 - RNA, 18 nt, Homo Sapiens
ggagcugucgucacugcg

SEQ ID NO: 5729 - RNA, 80 nt, Homo Sapiens
gggcgcuaacacacacaacggcgcucugggggggcgccacaacacccccuuguagaccgcaauuggucguuuagcgcacc

SEQ ID NO: 5730 - RNA, 24 nt, Homo Sapiens
uaacacacacaacggcgcucuggg

SEQ ID NO: 5731 - RNA, 23 nt, Homo Sapiens
aacacacacgaaacacugcucug

SEQ ID NO: 5732 - RNA, 22 nt, Homo Sapiens
aacacacacacacagagcugug

SEQ ID NO: 5733 - RNA, 23 nt, Homo Sapiens
aaaacacacaacgguacuacugg

SEQ ID NO: 5734 - RNA, 22 nt, Homo Sapiens
aacaaacccaucucgcucuggg

SEQ ID NO: 5735 - RNA, 24 nt, Homo Sapiens
acacacacaccgcacggccggcuc

SEQ ID NO: 5736 - RNA, 19 nt, Homo Sapiens
acacacacacacaacgcuc

SEQ ID NO: 5737 - RNA, 20 nt, Homo Sapiens
acacacacacacggcgcucu

SEQ ID NO: 5738 - RNA, 20 nt, Homo Sapiens
acacacacaggcugcggucu

SEQ ID NO: 5739 - RNA, 21 nt, Homo Sapiens
acacacacacacugcgcgcug

SEQ ID NO: 5740 - RNA, 19 nt, Homo Sapiens
acacacacacagucucucu

SEQ ID NO: 5741 - RNA, 19 nt, Homo Sapiens
acacacacaugcucgcucu

SEQ ID NO: 5742 - RNA, 19 nt, Homo Sapiens
acacacacagcgcguugug

SEQ ID NO: 5743 - RNA, 20 nt, Homo Sapiens
acacacacauccucccucug

SEQ ID NO: 5744 - RNA, 21 nt, Homo Sapiens
acacacacagcugaucccugg

SEQ ID NO: 5745 - RNA, 21 nt, Homo Sapiens
cacaccuacgccgcgcucugg

SEQ ID NO: 5746 - RNA, 16 nt, Homo Sapiens
cacacacaauggucug

SEQ ID NO: 5747 - RNA, 60 nt, Homo Sapiens
gggcguaugccuuuccuggaggcggggacgauccggguaggagacaaagggcgagcuccc

SEQ ID NO: 5748 - RNA, 24 nt, Homo Sapiens
uccggguaggagacaaagggcgag

SEQ ID NO: 5749 - RNA, 22 nt, Homo Sapiens
ccgggaacuggagcaaagggcg

SEQ ID NO: 5750 - RNA, 22 nt, Homo Sapiens
ccggguaggagcagguggcaag

SEQ ID NO: 5751 - RNA, 20 nt, Homo Sapiens
cggguaggacagacagaugg

SEQ ID NO: 5752 - RNA, 21 nt, Homo Sapiens
cgguucugaggcaagggcgag

SEQ ID NO: 5753 - RNA, 19 nt, Homo Sapiens
ggguagagaggacaaaggg

SEQ ID NO: 5754 - RNA, 21 nt, Homo Sapiens
ggguggagccugaaagggcga

SEQ ID NO: 5755 - RNA, 23 nt, Homo Sapiens
ggguaggagaggaccagggagag

SEQ ID NO: 5756 - RNA, 22 nt, Homo Sapiens
ggguaggagugaagggcagcga

SEQ ID NO: 5757 - RNA, 20 nt, Homo Sapiens
gggaaggagacaaugagaga

SEQ ID NO: 5758 - RNA, 20 nt, Homo Sapiens
ggggaggggacaagggcgag

SEQ ID NO: 5759 - RNA, 20 nt, Homo Sapiens
ggguaggagcgacggucgag

SEQ ID NO: 5760 - RNA, 19 nt, Homo Sapiens
ggguaggagccaggccgag

SEQ ID NO: 5761 - RNA, 23 nt, Homo Sapiens
ucaggaguaggagacaaggcgcg

SEQ ID NO: 5762 - RNA, 19 nt, Homo Sapiens
ucgggggauagacaaaggg

SEQ ID NO: 5763 - RNA, 20 nt, Homo Sapiens
ucuggggcagagacaaaggg

SEQ ID NO: 5764 - RNA, 23 nt, Homo Sapiens
uccggcccgcggacaaaggggag

SEQ ID NO: 5765 - RNA, 64 nt, Homo Sapiens
gggcuggcgucuggguggggugggcgcgguugggcggcguccgcccauaguuccgcgcgugccc

SEQ ID NO: 5766 - RNA, 24 nt, Homo Sapiens
uggcgucuggguggggugggcgcg

SEQ ID NO: 5767 - RNA, 20 nt, Homo Sapiens
cgacucgguaaggugggcgc

SEQ ID NO: 5768 - RNA, 21 nt, Homo Sapiens
cugggugggugggugggugcg

SEQ ID NO: 5769 - RNA, 23 nt, Homo Sapiens
gccucuugugguggggugggggc

SEQ ID NO: 5770 - RNA, 22 nt, Homo Sapiens
gcgucugggcuuugugugagcg

SEQ ID NO: 5771 - RNA, 25 nt, Homo Sapiens
ggcggcggagggggcggugggcgcg

SEQ ID NO: 5772 - RNA, 24 nt, Homo Sapiens
ggcgggcgggacugcggugggcgc

SEQ ID NO: 5773 - RNA, 24 nt, Homo Sapiens
ggcgucugggauggucugcaggcg

SEQ ID NO: 5774 - RNA, 20 nt, Homo Sapiens
ggcgucuggguccugguggg

SEQ ID NO: 5775 - RNA, 25 nt, Homo Sapiens
ggcgucuggagggccggucagcgcg

SEQ ID NO: 5776 - RNA, 22 nt, Homo Sapiens
ggcaucugggugggcccugggc

SEQ ID NO: 5777 - RNA, 24 nt, Homo Sapiens
ggccgcuggguggggucccgggcg

SEQ ID NO: 5778 - RNA, 17 nt, Homo Sapiens
ggcucuggguggguggg

SEQ ID NO: 5779 - RNA, 19 nt, Homo Sapiens
ggcggcgaggugggguggg

SEQ ID NO: 5780 - RNA, 20 nt, Homo Sapiens
ggccccaggguggggugggc

SEQ ID NO: 5781 - RNA, 18 nt, Homo Sapiens
ggcguggcuggggugggc

SEQ ID NO: 5782 - RNA, 20 nt, Homo Sapiens
gggguggggguggggugggc

SEQ ID NO: 5783 - RNA, 22 nt, Homo Sapiens
ggccuuuggguggggucggggc

SEQ ID NO: 5784 - RNA, 20 nt, Homo Sapiens
ggcguccgccuggugggcgc

SEQ ID NO: 5785 - RNA, 19 nt, Homo Sapiens
ggcgucugggggugggggc

SEQ ID NO: 5786 - RNA, 21 nt, Homo Sapiens
guccgggcaggagugggcgcg

SEQ ID NO: 5787 - RNA, 26 nt, Homo Sapiens
uggacgcugccgguggggugggggcg

SEQ ID NO: 5788 - RNA, 23 nt, Homo Sapiens
uggcgcucagggugggguagccg

SEQ ID NO: 5789 - RNA, 22 nt, Homo Sapiens
uggcgucuguggugucugggcg

SEQ ID NO: 5790 - RNA, 19 nt, Homo Sapiens
uggaguggggugggguggg

SEQ ID NO: 5791 - RNA, 18 nt, Homo Sapiens
uggcgggggugggguggg

SEQ ID NO: 5792 - RNA, 20 nt, Homo Sapiens
uggggacauggugggguggg

SEQ ID NO: 5793 - RNA, 19 nt, Homo Sapiens
ugggguggggugggguggg

SEQ ID NO: 5794 - RNA, 20 nt, Homo Sapiens
uggguguggguggggagggc

SEQ ID NO: 5795 - RNA, 21 nt, Homo Sapiens
uggcgucugacuggccugggc

SEQ ID NO: 5796 - RNA, 18 nt, Homo Sapiens
uggcuucugggggugggc

SEQ ID NO: 5797 - RNA, 20 nt, Homo Sapiens
uggccuccguggggugggcg

SEQ ID NO: 5798 - RNA, 20 nt, Homo Sapiens
uggcguggguggggagagcg

SEQ ID NO: 5799 - RNA, 23 nt, Homo Sapiens
uggagcugggugggguuggcacg

SEQ ID NO: 5800 - RNA, 130 nt, Homo Sapiens
ggggaaccgcgguggcuuccgcggagguuucggcaguggcauccggggccggggucgcggccguggacggggccggggccgaggccgcggagcucgcggaggcaaggccgaggauaaggaguggaugccc

SEQ ID NO: 5801 - RNA, 24 nt, Homo Sapiens
uggcauccggggccggggucgcgg

SEQ ID NO: 5802 - RNA, 20 nt, Homo Sapiens
aucccgggccgggguggggg

SEQ ID NO: 5803 - RNA, 19 nt, Homo Sapiens
cauucggggccggaguggc

SEQ ID NO: 5804 - RNA, 25 nt, Homo Sapiens
gcauaccugggacccggggucgggg

SEQ ID NO: 5805 - RNA, 21 nt, Homo Sapiens
gggaugccggggccgaggccg

SEQ ID NO: 5806 - RNA, 24 nt, Homo Sapiens
ggcauccggggccaguggugucgg

SEQ ID NO: 5807 - RNA, 18 nt, Homo Sapiens
ggcuccgaggccgggguc

SEQ ID NO: 5808 - RNA, 17 nt, Homo Sapiens
ggcaggggccggggacg

SEQ ID NO: 5809 - RNA, 19 nt, Homo Sapiens
ggcacagggccgggguggc

SEQ ID NO: 5810 - RNA, 19 nt, Homo Sapiens
ggcugccgggcggggucgc

SEQ ID NO: 5811 - RNA, 23 nt, Homo Sapiens
ggcggccugggccgggguugagg

SEQ ID NO: 5812 - RNA, 19 nt, Homo Sapiens
ucgggggccgggguggagg

SEQ ID NO: 5813 - RNA, 130 nt, Homo Sapiens
ggggaaccgcgguggcuuccgcggagguuucggcaguggcauucggggccggggucgcggccguggacggggccggggccgaggccgcggagcucgcggaggcaaggccgaggauaaggaguggaugccc

SEQ ID NO: 5814 - RNA, 24 nt, Homo Sapiens
uggcauucggggccggggucgcgg

SEQ ID NO: 5815 - RNA, 17 nt, Homo Sapiens
auuggggccgggcgcgg

SEQ ID NO: 5816 - RNA, 20 nt, Homo Sapiens
cggggccgggguguccgcgg

SEQ ID NO: 5817 - RNA, 23 nt, Homo Sapiens
gcagaccgggauccggggucgcg

SEQ ID NO: 5818 - RNA, 22 nt, Homo Sapiens
gcauucgggggaggcaguggcg

SEQ ID NO: 5819 - RNA, 27 nt, Homo Sapiens
ggcacaguucgggggccgggguggagg

SEQ ID NO: 5820 - RNA, 19 nt, Homo Sapiens
ggcagcuccggggccgggg

SEQ ID NO: 5821 - RNA, 24 nt, Homo Sapiens
ggcagcucccgggccggggccgcg

SEQ ID NO: 5822 - RNA, 24 nt, Homo Sapiens
ggcagcuccggggccggggccucg

SEQ ID NO: 5823 - RNA, 19 nt, Homo Sapiens
ggcugccgggcggggucgc

SEQ ID NO: 5824 - RNA, 19 nt, Homo Sapiens
ggcagcggggccggggcgc

SEQ ID NO: 5825 - RNA, 22 nt, Homo Sapiens
ggcugcggggccgggggcgagg

SEQ ID NO: 5826 - RNA, 19 nt, Homo Sapiens
ggcaaucgccgggguccgg

SEQ ID NO: 5827 - RNA, 22 nt, Homo Sapiens
gggauucgauccggggucgggg

SEQ ID NO: 5828 - RNA, 20 nt, Homo Sapiens
ucgggaagggcggggucgcg

SEQ ID NO: 5829 - RNA, 21 nt, Homo Sapiens
ucugggacguuggggucgcgg

SEQ ID NO: 5830 - RNA, 27 nt, Homo Sapiens
uggcaccuuuccggccccgggucgcgg

SEQ ID NO: 5831 - RNA, 25 nt, Homo Sapiens
uggccuggcggggccccggggucgc

SEQ ID NO: 5832 - RNA, 19 nt, Homo Sapiens
ugcccuugguggccggggu

SEQ ID NO: 5833 - RNA, 20 nt, Homo Sapiens
uggacuggcggccggggucg

SEQ ID NO: 5834 - RNA, 24 nt, Homo Sapiens
ugacacucccagacggggucgcgg

SEQ ID NO: 5835 - RNA, 17 nt, Homo Sapiens
uuaggggccgggcgcgg

SEQ ID NO: 5836 - RNA, 17 nt, Homo Sapiens
uucgggccggggcgcgg

SEQ ID NO: 5837 - RNA, 61 nt, Homo Sapiens
ggggagaauagaaagaaaacaauugacaaaauccucaaauguaaacucaauuugccucccu

SEQ ID NO: 5838 - RNA, 22 nt, Homo Sapiens
uguaaacucaauuugccucccu

SEQ ID NO: 5839 - RNA, 19 nt, Homo Sapiens
aaacucaauuuugcucucu

SEQ ID NO: 5840 - RNA, 25 nt, Homo Sapiens
guaaauccucaauuugcuguucccu

SEQ ID NO: 5841 - RNA, 19 nt, Homo Sapiens
guaaacucauuuuuaccuc

SEQ ID NO: 5842 - RNA, 19 nt, Homo Sapiens
guaaacucaaauaucuucc

SEQ ID NO: 5843 - RNA, 20 nt, Homo Sapiens
uaaacaaaaugauuugccuc

SEQ ID NO: 5844 - RNA, 22 nt, Homo Sapiens
uguaaacuccagcuuggcuccc

SEQ ID NO: 5845 - RNA, 19 nt, Homo Sapiens
uguuaauucuaauuugccu

SEQ ID NO: 5846 - RNA, 21 nt, Homo Sapiens
uguaugcucauauuugccucc

SEQ ID NO: 5847 - RNA, 24 nt, Homo Sapiens
ugcaaccucaaaagcugccucccu

SEQ ID NO: 5848 - RNA, 19 nt, Homo Sapiens
uguaaaccaauuugccucc

SEQ ID NO: 5849 - RNA, 75 nt, Homo Sapiens
ggggauggaaggcgauggccccugcgaggacgauggcccggcccgccucgccccggcggcaucccugccgucgcc

SEQ ID NO: 5850 - RNA, 24 nt, Homo Sapiens
aaggcgauggccccugcgaggacg

SEQ ID NO: 5851 - RNA, 20 nt, Homo Sapiens
aggcgguggcggcgaggacg

SEQ ID NO: 5852 - RNA, 18 nt, Homo Sapiens
gcgauggccgagagggcg

SEQ ID NO: 5853 - RNA, 90 nt, Homo Sapiens
gggggacugaauggcgcauuccgggcgggagggcaaaacaaccccacugguuuuccccgcccccccuggaaucugccccccguguccccc

SEQ ID NO: 5854 - RNA, 24 nt, Homo Sapiens
uggcgcauuccgggcgggagggca

SEQ ID NO: 5855 - RNA, 22 nt, Homo Sapiens
cgcaggccgggcgcgggagggc

SEQ ID NO: 5856 - RNA, 19 nt, Homo Sapiens
gcaucucggagggagggca

SEQ ID NO: 5857 - RNA, 27 nt, Homo Sapiens
gcgcaccguugcaggcgcgggagggca

SEQ ID NO: 5858 - RNA, 18 nt, Homo Sapiens
gcgcguccgggcgguagg

SEQ ID NO: 5859 - RNA, 24 nt, Homo Sapiens
ggcgucuguccgggcggcgcgggc

SEQ ID NO: 5860 - RNA, 21 nt, Homo Sapiens
ggagcacgcgcgggcgggagg

SEQ ID NO: 5861 - RNA, 22 nt, Homo Sapiens
ggcgcccagcgaggcgggaggg

SEQ ID NO: 5862 - RNA, 19 nt, Homo Sapiens
ggcgcagcgugggcgggag

SEQ ID NO: 5863 - RNA, 17 nt, Homo Sapiens
ggcguccgggcggcagg

SEQ ID NO: 5864 - RNA, 19 nt, Homo Sapiens
ggcgcauggggcgggaggg

SEQ ID NO: 5865 - RNA, 21 nt, Homo Sapiens
ggcgcuggcgggcgggacggc

SEQ ID NO: 5866 - RNA, 19 nt, Homo Sapiens
ggcucauuccggggagcgc

SEQ ID NO: 5867 - RNA, 22 nt, Homo Sapiens
ggcucgugcagggcgggagagc

SEQ ID NO: 5868 - RNA, 21 nt, Homo Sapiens
ggugcaccuggcgggagggca

SEQ ID NO: 5869 - RNA, 20 nt, Homo Sapiens
uggccagcauuggcgggagg

SEQ ID NO: 5870 - RNA, 24 nt, Homo Sapiens
uggcagguuuccuggggcgggagg

SEQ ID NO: 5871 - RNA, 28 nt, Homo Sapiens
uggcgcgcucgcccacgggcgggagggc

SEQ ID NO: 5872 - RNA, 22 nt, Homo Sapiens
uggcggcugcugugcgggaggg

SEQ ID NO: 5873 - RNA, 20 nt, Homo Sapiens
uggccauccgggcggagcgc

SEQ ID NO: 5874 - RNA, 22 nt, Homo Sapiens
uggcucgguccccgggagggca

SEQ ID NO: 5875 - RNA, 83 nt, Homo Sapiens
gggggaguuguggugcuucugggucucugggccccgccugcuggccugggaugcccucauguugggaagcauuccgugccccc

SEQ ID NO: 5876 - RNA, 83 nt, Homo Sapiens; identical to SEQ ID NO: 5875

SEQ ID NO: 5877 - RNA, 83 nt, Homo Sapiens; identical to SEQ ID NO: 5875

SEQ ID NO: 5878 - RNA, 83 nt, Homo Sapiens; identical to SEQ ID NO: 5875

SEQ ID NO: 5879 - RNA, 78 nt, Homo Sapiens
ggggggaggaacccaccaacagggggggucuccacaacuccucaguguccgccccacuugugucgggaagcccccccc

SEQ ID NO: 5880 - RNA, 24 nt, Homo Sapiens
uccgccccacuugugucgggaagc

SEQ ID NO: 5881 - RNA, 21 nt, Homo Sapiens
cccacuuguaagucagggaag

SEQ ID NO: 5882 - RNA, 24 nt, Homo Sapiens
ccccaugcuuucugggucgggaag

SEQ ID NO: 5883 - RNA, 19 nt, Homo Sapiens
ccgagccccgugugucggg

SEQ ID NO: 5884 - RNA, 16 nt, Homo Sapiens
ccgccccacgucgaga

SEQ ID NO: 5885 - RNA, 22 nt, Homo Sapiens
ccgccccacgcguggcuggcag

SEQ ID NO: 5886 - RNA, 19 nt, Homo Sapiens
cgccccacuggccuguguc

SEQ ID NO: 5887 - RNA, 21 nt, Homo Sapiens
gcccuggcgcuugugucggga

SEQ ID NO: 5888 - RNA, 18 nt, Homo Sapiens
gcaccgcuggucgggaag

SEQ ID NO: 5889 - RNA, 28 nt, Homo Sapiens
uccuccccggcucgggugucgggagagc

SEQ ID NO: 5890 - RNA, 19 nt, Homo Sapiens
ucccgcccacuugugggga

SEQ ID NO: 5891 - RNA, 21 nt, Homo Sapiens
uccccgcacugguggggacgc

SEQ ID NO: 5892 - RNA, 67 nt, Homo Sapiens
ggggggcaccaaugacaagggaauugggauggggaugacagucccuauuuccuuugcuguguucccc

SEQ ID NO: 5893 - RNA, 24 nt, Homo Sapiens
ugacaagggaauugggauggggau

SEQ ID NO: 5894 - RNA, 20 nt, Homo Sapiens
aaggaacauggggaugggga

SEQ ID NO: 5895 - RNA, 21 nt, Homo Sapiens
acacaggcaacagggaugggg

SEQ ID NO: 5896 - RNA, 20 nt, Homo Sapiens
acagagggaggggaugggga

SEQ ID NO: 5897 - RNA, 20 nt, Homo Sapiens
acaagggaaguugggcuagg

SEQ ID NO: 5898 - RNA, 18 nt, Homo Sapiens
acaaggaauugggguagg

SEQ ID NO: 5899 - RNA, 20 nt, Homo Sapiens
aggaaaguaggggaugggga

SEQ ID NO: 5900 - RNA, 22 nt, Homo Sapiens
caggggaacuccgggaugggga

SEQ ID NO: 5901 - RNA, 19 nt, Homo Sapiens
cacggggguggggaugggg

SEQ ID NO: 5902 - RNA, 18 nt, Homo Sapiens
caagggaaugaaagggga

SEQ ID NO: 5903 - RNA, 21 nt, Homo Sapiens
gacagagggagaggaugggga

SEQ ID NO: 5904 - RNA, 23 nt, Homo Sapiens
gacaagggcgagaggggaugggg

SEQ ID NO: 5905 - RNA, 24 nt, Homo Sapiens
gacaugggugggagugggaugggg

SEQ ID NO: 5906 - RNA, 20 nt, Homo Sapiens
gacaagggagagagggaggg

SEQ ID NO: 5907 - RNA, 20 nt, Homo Sapiens
gacaaugagauggaugggga

SEQ ID NO: 5908 - RNA, 20 nt, Homo Sapiens
ugagcaggggaaauugggau

SEQ ID NO: 5909 - RNA, 22 nt, Homo Sapiens
ugacaagggagggccagauggg

SEQ ID NO: 5910 - RNA, 22 nt, Homo Sapiens
ugucaggggaugggggaugggg

SEQ ID NO: 5911 - RNA, 22 nt, Homo Sapiens
ugccaagggaaucaggaggaga

SEQ ID NO: 5912 - RNA, 24 nt, Homo Sapiens
ugcccaggcauaugggauggguau

SEQ ID NO: 5913 - RNA, 60 nt, Homo Sapiens
gggggucguccuuggcacgcgcuggggagugcuaguccugaggcgagccgguagaucucc

SEQ ID NO: 5914 - RNA, 20 nt, Homo Sapiens
aggcgagccgguagaucucc

SEQ ID NO: 5915 - RNA, 20 nt, Homo Sapiens
aggcgagcccgagggagcuc

SEQ ID NO: 5916 - RNA, 22 nt, Homo Sapiens
agccaagccccggguagaucuc

SEQ ID NO: 5917 - RNA, 19 nt, Homo Sapiens
agggagacggguagaucuc

SEQ ID NO: 5918 - RNA, 20 nt, Homo Sapiens
aggugagauggguagaucuc

SEQ ID NO: 5919 - RNA, 20 nt, Homo Sapiens
agggcagacacuagaucucc

SEQ ID NO: 5920 - RNA, 21 nt, Homo Sapiens
gcgacacgccgguagagcacc

SEQ ID NO: 5921 - RNA, 21 nt, Homo Sapiens
ggcgagccgcucggagaccuc

SEQ ID NO: 5922 - RNA, 20 nt, Homo Sapiens
ggcgagccgcugguagcucc

SEQ ID NO: 5923 - RNA, 18 nt, Homo Sapiens
ggcgagccgugguccucc

SEQ ID NO: 5924 - RNA, 72 nt, Homo Sapiens
gggguaguggauggcaacugauggaacaggagaaugcucagcagcauuugcucuuccagccugucacgccuc

SEQ ID NO: 5925 - RNA, 24 nt, Homo Sapiens
uggcaacugauggaacaggagaau

SEQ ID NO: 5926 - RNA, 21 nt, Homo Sapiens
aacugaaauggaacaggagaa

SEQ ID NO: 5927 - RNA, 21 nt, Homo Sapiens
aacugauggcaacuucagaau

SEQ ID NO: 5928 - RNA, 21 nt, Homo Sapiens
cagcagauggaacagauagaa

SEQ ID NO: 5929 - RNA, 21 nt, Homo Sapiens
caacugaugaagcuggagcau

SEQ ID NO: 5930 - RNA, 24 nt, Homo Sapiens
ggcaacuuacugaccacaggagaa

SEQ ID NO: 5931 - RNA, 22 nt, Homo Sapiens
gggaccugauggaacugcagaa

SEQ ID NO: 5932 - RNA, 23 nt, Homo Sapiens
ggaaacuggaggaacaggaguau

SEQ ID NO: 5933 - RNA, 22 nt, Homo Sapiens
gggaaaagaggagcaggagaau

SEQ ID NO: 5934 - RNA, 22 nt, Homo Sapiens
ugggagacugaggcaggagaau

SEQ ID NO: 5935 - RNA, 22 nt, Homo Sapiens
ugggaagcugaggcaggagaau

SEQ ID NO: 5936 - RNA, 26 nt, Homo Sapiens
ugguuacgugguaggcacaggagaau

SEQ ID NO: 5937 - RNA, 25 nt, Homo Sapiens
uggcaacugggccagugggacagga

SEQ ID NO: 5938 - RNA, 23 nt, Homo Sapiens
ugggcacugauggcaacaggaga

SEQ ID NO: 5939 - RNA, 19 nt, Homo Sapiens
uggucacugauggacacag

SEQ ID NO: 5940 - RNA, 26 nt, Homo Sapiens
ugaccacugauggagacaacacgaau

SEQ ID NO: 5941 - RNA, 18 nt, Homo Sapiens
ugacaacaauggaacagg

SEQ ID NO: 5942 - RNA, 21 nt, Homo Sapiens
ugacaagugacagaacaggag

SEQ ID NO: 5943 - RNA, 20 nt, Homo Sapiens
uggcacugauggacagaaga

SEQ ID NO: 5944 - RNA, 21 nt, Homo Sapiens
uggcaagaggaucaggagaau

SEQ ID NO: 5945 - RNA, 68 nt, Homo Sapiens
ggguaaucagggaagugguauuucagcagggaccuaaaggaugagaagacacaaaccugcaaagaccc

SEQ ID NO: 5946 - RNA, 24 nt, Homo Sapiens
ugagaagacacaaaccugcaaaga

SEQ ID NO: 5947 - RNA, 20 nt, Homo Sapiens
aagacacaaaagaugcaaag

SEQ ID NO: 5948 - RNA, 21 nt, Homo Sapiens
aagaauuaauaccugcaaaga

SEQ ID NO: 5949 - RNA, 20 nt, Homo Sapiens
aagacacaaaagaccaaaga

SEQ ID NO: 5950 - RNA, 19 nt, Homo Sapiens
agagagacacaaacaagca

SEQ ID NO: 5951 - RNA, 22 nt, Homo Sapiens
agaagaaauaaagaccugcaaa

SEQ ID NO: 5952 - RNA, 19 nt, Homo Sapiens
agaugacaacaaccugcaa

SEQ ID NO: 5953 - RNA, 18 nt, Homo Sapiens
agaagacacccuccaaag

SEQ ID NO: 5954 - RNA, 19 nt, Homo Sapiens
aggcacagcaaccugcaaa

SEQ ID NO: 5955 - RNA, 21 nt, Homo Sapiens
agacacaaaucccuggaaaga

SEQ ID NO: 5956 - RNA, 22 nt, Homo Sapiens
gaacgacacaaacuuaaaaaga

SEQ ID NO: 5957 - RNA, 20 nt, Homo Sapiens
gaagaccuacuaaccugcaa

SEQ ID NO: 5958 - RNA, 16 nt, Homo Sapiens
gaagacaaccugcaaa

SEQ ID NO: 5959 - RNA, 19 nt, Homo Sapiens
gagaugagacacaaaccug

SEQ ID NO: 5960 - RNA, 24 nt, Homo Sapiens
gagaagacacugaaaucgcugcaa

SEQ ID NO: 5961 - RNA, 23 nt, Homo Sapiens
gagaagacagaaauccaugccaa

SEQ ID NO: 5962 - RNA, 24 nt, Homo Sapiens
gagaagacacagacacacauaaga

SEQ ID NO: 5963 - RNA, 20 nt, Homo Sapiens
gagaagacagaaagcuguaa

SEQ ID NO: 5964 - RNA, 19 nt, Homo Sapiens
gacaagacacaaacucaaa

SEQ ID NO: 5965 - RNA, 21 nt, Homo Sapiens
gagaagacagaaacagaaaag

SEQ ID NO: 5966 - RNA, 26 nt, Homo Sapiens
ugugaagacacagaaagauucaaaga

SEQ ID NO: 5967 - RNA, 23 nt, Homo Sapiens
ugagaaaaaaccaaaccugcaaa

SEQ ID NO: 5968 - RNA, 24 nt, Homo Sapiens
ugugaagaguccaaccugcaagga

SEQ ID NO: 5969 - RNA, 76 nt, Homo Sapiens
ggguccacuaucauuuaauuucccuugaaccugcucugcuaguuuaaucugcuaauaugaaaguuaauuaagaccu

SEQ ID NO: 5970 - RNA, 24 nt, Homo Sapiens
uaucauuuaauuucccuugaaccu

SEQ ID NO: 5971 - RNA, 20 nt, Homo Sapiens
auuauuuaauuucuucccuu

SEQ ID NO: 5972 - RNA, 20 nt, Homo Sapiens
uaucauugauauaauuuccc

SEQ ID NO: 5973 - RNA, 16 nt, Homo Sapiens
uaucauuuaauucuug

SEQ ID NO: 5974 - RNA, 20 nt, Homo Sapiens
uaucauuuaauacaacuuga

SEQ ID NO: 5975 - RNA, 80 nt, Homo Sapiens
gggugaagauggcggcagccgaggccgcgaacugcaucauggagguguccuguggccaggcggaaagcagugagaagccc

SEQ ID NO: 5976 - RNA, 24 nt, Homo Sapiens
uggcggcagccgaggccgcgaacu

SEQ ID NO: 5977 - RNA, 18 nt, Homo Sapiens
gcagccgagacagcaacu

SEQ ID NO: 5978 - RNA, 19 nt, Homo Sapiens
gccgaggccccagcgaccu

SEQ ID NO: 5979 - RNA, 24 nt, Homo Sapiens
gcggcacagagaggccgcguaacu

SEQ ID NO: 5980 - RNA, 21 nt, Homo Sapiens
ggcggcagcugggcaggccgc

SEQ ID NO: 5981 - RNA, 23 nt, Homo Sapiens
ggcggcagcggcgggcucgaccu

SEQ ID NO: 5982 - RNA, 20 nt, Homo Sapiens
ugccgguggccgaggccgcg

SEQ ID NO: 5983 - RNA, 19 nt, Homo Sapiens
uggcggcagcgggccggga

SEQ ID NO: 5984 - RNA, 21 nt, Homo Sapiens
uggcggcagccgggagggaac

SEQ ID NO: 5985 - RNA, 66 nt, Homo Sapiens
gggugagaggcuggugguugccucccguccugggcaggcugcagccucaugccaugucucucuccc

SEQ ID NO: 5986 - RNA, 24 nt, Homo Sapiens
ugagaggcuggugguugccucccg

SEQ ID NO: 5987 - RNA, 22 nt, Homo Sapiens
agaggcugggcuccuggccucc

SEQ ID NO: 5988 - RNA, 19 nt, Homo Sapiens
agagcuggugguguuccuc

SEQ ID NO: 5989 - RNA, 20 nt, Homo Sapiens
agaggcuggcaguggcuucc

SEQ ID NO: 5990 - RNA, 23 nt, Homo Sapiens
agguugguguguaguugccuccc

SEQ ID NO: 5991 - RNA, 19 nt, Homo Sapiens
agccuggccuuugccuccc

SEQ ID NO: 5992 - RNA, 20 nt, Homo Sapiens
agacucgugugugccucccg

SEQ ID NO: 5993 - RNA, 20 nt, Homo Sapiens
gagaggcuggucaugguggc

SEQ ID NO: 5994 - RNA, 28 nt, Homo Sapiens
gagcggcugguagcuccguugccucccg

SEQ ID NO: 5995 - RNA, 21 nt, Homo Sapiens
gagaggcuguuaggagacucc

SEQ ID NO: 5996 - RNA, 22 nt, Homo Sapiens
gaggccuggagccugccucccg

SEQ ID NO: 5997 - RNA, 24 nt, Homo Sapiens
gaggcugccugguucugccucccg

SEQ ID NO: 5998 - RNA, 21 nt, Homo Sapiens
gaggcccuugguugccuuccg

SEQ ID NO: 5999 - RNA, 19 nt, Homo Sapiens
gaggguggggugccucccg

SEQ ID NO: 6000 - RNA, 20 nt, Homo Sapiens
ggcugcgcggcugccucccg

SEQ ID NO: 6001 - RNA, 19 nt, Homo Sapiens
ggcugguggcugcggcucc

SEQ ID NO: 6002 - RNA, 26 nt, Homo Sapiens
ugaaaggcaagggggcuugccucccg

SEQ ID NO: 6003 - RNA, 20 nt, Homo Sapiens
ugagaggcuccuggugcccu

SEQ ID NO: 6004 - RNA, 19 nt, Homo Sapiens
ugagggcugguggaccucc

SEQ ID NO: 6005 - RNA, 22 nt, Homo Sapiens
ugggaggcugguggcuacuccc

SEQ ID NO: 6006 - RNA, 22 nt, Homo Sapiens
ugaggggcugguggcucccccg

SEQ ID NO: 6007 - RNA, 63 nt, Homo Sapiens
gggugcgggacuuaaacacaaccuggaccucguggggcgggugcccacuaaagugcuggaccc

SEQ ID NO: 6008 - RNA, 24 nt, Homo Sapiens
ugcgggacuuaaacacaaccugga

SEQ ID NO: 6009 - RNA, 24 nt, Homo Sapiens
cgggacuggucgaggacaaccugg

SEQ ID NO: 6010 - RNA, 19 nt, Homo Sapiens
cgggacuuauuuagcaacc

SEQ ID NO: 6011 - RNA, 19 nt, Homo Sapiens
gaauuaacucacacaaccu

SEQ ID NO: 6012 - RNA, 19 nt, Homo Sapiens
gcuggauuaacaaccugga

SEQ ID NO: 6013 - RNA, 21 nt, Homo Sapiens
ggaguucaagaucaaccugga

SEQ ID NO: 6014 - RNA, 24 nt, Homo Sapiens
gggacuaauaaaccucacaaccug

SEQ ID NO: 6015 - RNA, 21 nt, Homo Sapiens
gggacuuaaacagcaccccgg

SEQ ID NO: 6016 - RNA, 19 nt, Homo Sapiens
gggacuuaaggacaauccu

SEQ ID NO: 6017 - RNA, 26 nt, Homo Sapiens
ugcgggacucugaaacagcauaugga

SEQ ID NO: 6018 - RNA, 22 nt, Homo Sapiens
ugcagcaguuaaacacagucug

SEQ ID NO: 6019 - RNA, 72 nt, Homo Sapiens
ggguggcagcaccaggggacacaccugccaaacccaccagauggaggggcccucccuggucucuggccaccc

SEQ ID NO: 6020 - RNA, 24 nt, Homo Sapiens
uggcagcaccaggggacacaccug

SEQ ID NO: 6021 - RNA, 18 nt, Homo Sapiens
gcagacucaggggacaca

SEQ ID NO: 6022 - RNA, 20 nt, Homo Sapiens
gcagcaccagaggaacccac

SEQ ID NO: 6023 - RNA, 22 nt, Homo Sapiens
ggcagcaccaggagggucccac

SEQ ID NO: 6024 - RNA, 20 nt, Homo Sapiens
ggcagagccaggggaccaca

SEQ ID NO: 6025 - RNA, 17 nt, Homo Sapiens
ggcagcauggggacaca

SEQ ID NO: 6026 - RNA, 18 nt, Homo Sapiens
ggcugcaaggggacacac

SEQ ID NO: 6027 - RNA, 22 nt, Homo Sapiens
ggcagcaccaaggcaaccuccu

SEQ ID NO: 6028 - RNA, 23 nt, Homo Sapiens
ggcagcaccaggggucuggccug

SEQ ID NO: 6029 - RNA, 28 nt, Homo Sapiens
uggucagccaccaggggagcccacgccu

SEQ ID NO: 6030 - RNA, 29 nt, Homo Sapiens
uggcagaacucgcccgcgggacacaccug

SEQ ID NO: 6031 - RNA, 23 nt, Homo Sapiens
ugacaacaccaaugggacacacc

SEQ ID NO: 6032 - RNA, 20 nt, Homo Sapiens
ugacagcaucugggacacac

SEQ ID NO: 6033 - RNA, 85 nt, Homo Sapiens
ggguuaucugcaacugagaggggcugguuaaggcguccccaaguuggaagggcgcuuugcuucuguuuucuggaugcagaguccu

SEQ ID NO: 6034 - RNA, 24 nt, Homo Sapiens
ugagaggggcugguuaaggcgucc

SEQ ID NO: 6035 - RNA, 15 nt, Homo Sapiens
agaggggcugaggcg

SEQ ID NO: 6036 - RNA, 21 nt, Homo Sapiens
agugggacaggaaaggcgucc

SEQ ID NO: 6037 - RNA, 19 nt, Homo Sapiens
aggggcuggagaggcgccc

SEQ ID NO: 6038 - RNA, 22 nt, Homo Sapiens
gagaggggcagggguccaggcg

SEQ ID NO: 6039 - RNA, 20 nt, Homo Sapiens
gaggcggcaggaaggcgucc

SEQ ID NO: 6040 - RNA, 22 nt, Homo Sapiens
gaggggcuguggcucaggaguc

SEQ ID NO: 6041 - RNA, 20 nt, Homo Sapiens
ggggcggcgcaaaggcgucc

SEQ ID NO: 6042 - RNA, 20 nt, Homo Sapiens
ugacaggggccugggugagg

SEQ ID NO: 6043 - RNA, 21 nt, Homo Sapiens
ugggaggggcugggcagggcg

SEQ ID NO: 6044 - RNA, 74 nt, Homo Sapiens
ggguuccaaugggugcacaguuccaaaaauguggagggacccuucucaguuuugaggccaugaauccaaagccc

SEQ ID NO: 6045 - RNA, 24 nt, Homo Sapiens
ugggugcacaguuccaaaaaugug

SEQ ID NO: 6046 - RNA, 20 nt, Homo Sapiens
acagauuccauaaaaaugug

SEQ ID NO: 6047 - RNA, 19 nt, Homo Sapiens
acauuuccuaaaaaaugug

SEQ ID NO: 6048 - RNA, 20 nt, Homo Sapiens
gcacaguucucgagaaugug

SEQ ID NO: 6049 - RNA, 19 nt, Homo Sapiens
gcaugguuccaaaagugug

SEQ ID NO: 6050 - RNA, 21 nt, Homo Sapiens
ggugcacagcgagugcaaaaa

SEQ ID NO: 6051 - RNA, 19 nt, Homo Sapiens
gguacaaagauuccaaaaa

SEQ ID NO: 6052 - RNA, 19 nt, Homo Sapiens
ggugcauuuaaaaaaugug

SEQ ID NO: 6053 - RNA, 19 nt, Homo Sapiens
guacacuuuuccaaaaaug

SEQ ID NO: 6054 - RNA, 20 nt, Homo Sapiens
gugcacucugacaaaaaugu

SEQ ID NO: 6055 - RNA, 19 nt, Homo Sapiens
ugcacaguuccucacaaug

SEQ ID NO: 6056 - RNA, 19 nt, Homo Sapiens
ugcacaguuugaucaaaau

SEQ ID NO: 6057 - RNA, 19 nt, Homo Sapiens
ugcacaguuccaucaaaug

SEQ ID NO: 6058 - RNA, 18 nt, Homo Sapiens
ugcacacuucaaaaaugu

SEQ ID NO: 6059 - RNA, 19 nt, Homo Sapiens
uggaaauuuccaaaaaugu

SEQ ID NO: 6060 - RNA, 20 nt, Homo Sapiens
uggacaacuacaaaaaugug

SEQ ID NO: 6061 - RNA, 20 nt, Homo Sapiens
ugggauuggaaaguuccaaa

SEQ ID NO: 6062 - RNA, 21 nt, Homo Sapiens
uggcugccccagguuccaaaa

SEQ ID NO: 6063 - RNA, 23 nt, Homo Sapiens
ugggugcacacuuggccuaaaau

SEQ ID NO: 6064 - RNA, 19 nt, Homo Sapiens
ugggagcacaguucgaaaa

SEQ ID NO: 6065 - RNA, 23 nt, Homo Sapiens
ugguugaagacuaccaaaaaugu

SEQ ID NO: 6066 - RNA, 75 nt, Homo Sapiens
gguagggagugaaaggcccggccaccuaaaggcacagcuggugccugggucaagcugaggcggcaucucucugcc

SEQ ID NO: 6067 - RNA, 24 nt, Homo Sapiens
ugaaaggcccggccaccuaaaggc

SEQ ID NO: 6068 - RNA, 20 nt, Homo Sapiens
aagaccagggccaccuagag

SEQ ID NO: 6069 - RNA, 21 nt, Homo Sapiens
aaggagaggccaccuauaagc

SEQ ID NO: 6070 - RNA, 23 nt, Homo Sapiens
gaaaggcccagcucaccuggagg

SEQ ID NO: 6071 - RNA, 19 nt, Homo Sapiens
gaacagcccugccaccuaa

SEQ ID NO: 6072 - RNA, 65 nt, Homo Sapiens
ggugaaggugcugaggaaagcucccaggaugagccugggagugcuucagguaucagcuuccagcc

SEQ ID NO: 6073 - RNA, 24 nt, Homo Sapiens
ugggagugcuucagguaucagcuu

SEQ ID NO: 6074 - RNA, 20 nt, Homo Sapiens
agugcuucacagauauaagc

SEQ ID NO: 6075 - RNA, 17 nt, Homo Sapiens
agugcuucaaauccgcu

SEQ ID NO: 6076 - RNA, 23 nt, Homo Sapiens
gagugcuucugaagguucaucag

SEQ ID NO: 6077 - RNA, 25 nt, Homo Sapiens
ggaguguugcagauuuuaucagcuu

SEQ ID NO: 6078 - RNA, 21 nt, Homo Sapiens
ggagccuuuugguaucagcuu

SEQ ID NO: 6079 - RNA, 21 nt, Homo Sapiens
gggagaaggugcagguaucag

SEQ ID NO: 6080 - RNA, 18 nt, Homo Sapiens
gggauuuccagguaucag

SEQ ID NO: 6081 - RNA, 21 nt, Homo Sapiens
gugacuucagguaagacgcuu

SEQ ID NO: 6082 - RNA, 20 nt, Homo Sapiens
guccuucagguaaucagcuu

SEQ ID NO: 6083 - RNA, 20 nt, Homo Sapiens
ugcuucagguacaucagguu

SEQ ID NO: 6084 - RNA, 20 nt, Homo Sapiens
ugggaacuugugcuucaggu

SEQ ID NO: 6085 - RNA, 24 nt, Homo Sapiens
ugggggugaacuuauagguaucag

SEQ ID NO: 6086 - RNA, 22 nt, Homo Sapiens
ugggagugcccuuuucagcuau

SEQ ID NO: 6087 - RNA, 21 nt, Homo Sapiens
ugggagugccucacuguucag

SEQ ID NO: 6088 - RNA, 18 nt, Homo Sapiens
ugggagugcucagucuca

SEQ ID NO: 6089 - RNA, 61 nt, Homo Sapiens
ggugacaacaugcuggagccaagugcuaacauggccuugguucaagggauggaaagucacc

SEQ ID NO: 6090 - RNA, 24 nt, Homo Sapiens
ugacaacaugcuggagccaagugc

SEQ ID NO: 6091 - RNA, 23 nt, Homo Sapiens
accacauuuaugcagccaagugc

SEQ ID NO: 6092 - RNA, 22 nt, Homo Sapiens
acagccagcugaggccaagugc

SEQ ID NO: 6093 - RNA, 19 nt, Homo Sapiens
acaagcggaagccaagugc

SEQ ID NO: 6094 - RNA, 17 nt, Homo Sapiens
acaugcuggccaagggc

SEQ ID NO: 6095 - RNA, 18 nt, Homo Sapiens
caacaugcugagaccaag

SEQ ID NO: 6096 - RNA, 17 nt, Homo Sapiens
caacaugcuagaagugc

SEQ ID NO: 6097 - RNA, 19 nt, Homo Sapiens
caugcuggagccagagggc

SEQ ID NO: 6098 - RNA, 20 nt, Homo Sapiens
gacaaucacaggcuggagcc

SEQ ID NO: 6099 - RNA, 22 nt, Homo Sapiens
gacuaccggaugcuggagcaaa

SEQ ID NO: 6100 - RNA, 23 nt, Homo Sapiens
gacaacaugcggcugaggaagug

SEQ ID NO: 6101 - RNA, 19 nt, Homo Sapiens
gaccacaugaggagccaag

SEQ ID NO: 6102 - RNA, 18 nt, Homo Sapiens
ugacaagggcuggagcca

SEQ ID NO: 6103 - RNA, 71 nt, Homo Sapiens
ggugccuggucaaucaguccucgggauggcagccaucaacccgugggccuccuggggugaccuuacggacc

SEQ ID NO: 6104 - RNA, 24 nt, Homo Sapiens
ucaguccucgggauggcagccauc

SEQ ID NO: 6105 - RNA, 22 nt, Homo Sapiens
aguccuggaaaacuggcagcca

SEQ ID NO: 6106 - RNA, 21 nt, Homo Sapiens
caguuccucgggauguucagc

SEQ ID NO: 6107 - RNA, 21 nt, Homo Sapiens
caguccugguggcgggauggc

SEQ ID NO: 6108 - RNA, 20 nt, Homo Sapiens
caguucaggauggcagacca

SEQ ID NO: 6109 - RNA, 20 nt, Homo Sapiens
caguccucguaaugcaucca

SEQ ID NO: 6110 - RNA, 20 nt, Homo Sapiens
cauuccugggggcagccauc

SEQ ID NO: 6111 - RNA, 21 nt, Homo Sapiens
ucaguccucagggagaccagc

SEQ ID NO: 6112 - RNA, 20 nt, Homo Sapiens
ucaguccucagggauugagc

SEQ ID NO: 6113 - RNA, 20 nt, Homo Sapiens
ucaguccucccgaccggagc

SEQ ID NO: 6114 - RNA, 20 nt, Homo Sapiens
ucagccgugggggcagccau

SEQ ID NO: 6115 - RNA, 24 nt, Homo Sapiens
ucaggccacgcaggggcagccauc

SEQ ID NO: 6116 - RNA, 20 nt, Homo Sapiens
uccuagacgggauggcagcc

SEQ ID NO: 6117 - RNA, 67 nt, Homo Sapiens
gguggggaagacugaagaaguguuaacugaaaacaggugacacagagucaccaguuuuccgagaacc

SEQ ID NO: 6118 - RNA, 24 nt, Homo Sapiens
ugacacagagucaccaguuuuccg

SEQ ID NO: 6119 - RNA, 21 nt, Homo Sapiens
acacaugaaaaaccaguuuuc

SEQ ID NO: 6120 - RNA, 20 nt, Homo Sapiens
acagaaaggcucaccaguuu

SEQ ID NO: 6121 - RNA, 23 nt, Homo Sapiens
acacagagcaguagccaguuuuc

SEQ ID NO: 6122 - RNA, 19 nt, Homo Sapiens
acacagaguaaaauguuuu

SEQ ID NO: 6123 - RNA, 20 nt, Homo Sapiens
acacccacacaccaguuuuc

SEQ ID NO: 6124 - RNA, 17 nt, Homo Sapiens
acccagaaccaguuuuc

SEQ ID NO: 6125 - RNA, 18 nt, Homo Sapiens
acacagagucaguuuucc

SEQ ID NO: 6126 - RNA, 19 nt, Homo Sapiens
acacagagucagguuuucc

SEQ ID NO: 6127 - RNA, 21 nt, Homo Sapiens
caccgagcuuugcaguuuucc

SEQ ID NO: 6128 - RNA, 23 nt, Homo Sapiens
cacagagucacaaauauuuuucc

SEQ ID NO: 6129 - RNA, 22 nt, Homo Sapiens
gacucagagacuacaguuuucc

SEQ ID NO: 6130 - RNA, 20 nt, Homo Sapiens
gacacaggagcaguuuuccg

SEQ ID NO: 6131 - RNA, 19 nt, Homo Sapiens
ugacacagagauccgcagu

SEQ ID NO: 6132 - RNA, 23 nt, Homo Sapiens
ugauaccagucaccagaauuucc

SEQ ID NO: 6133 - RNA, 19 nt, Homo Sapiens
ugaacagagucauaguuuu

SEQ ID NO: 6134 - RNA, 19 nt, Homo Sapiens
uggcacaggcaguuuuccg

SEQ ID NO: 6135 - RNA, 71 nt, Homo Sapiens
ggugugcccggaaccggcccuugguggggaaauaaugccuuugcuaagggggccccggauuccgggucgcc

SEQ ID NO: 6136 - RNA, 24 nt, Homo Sapiens
uaagggggccccggauuccggguc

SEQ ID NO: 6137 - RNA, 22 nt, Homo Sapiens
aagugcuccccaaggauuccgg

SEQ ID NO: 6138 - RNA, 20 nt, Homo Sapiens
aagggggccaaggacccggg

SEQ ID NO: 6139 - RNA, 22 nt, Homo Sapiens
aagggggccccagccuccgcgu

SEQ ID NO: 6140 - RNA, 24 nt, Homo Sapiens
aggagggccccggucuucccuguc

SEQ ID NO: 6141 - RNA, 19 nt, Homo Sapiens
agggggcccccauggcuuc

SEQ ID NO: 6142 - RNA, 19 nt, Homo Sapiens
aggaggccccggaguuccg

SEQ ID NO: 6143 - RNA, 25 nt, Homo Sapiens
agugggccccggcuucccugggguc

SEQ ID NO: 6144 - RNA, 19 nt, Homo Sapiens
agggggcccugacuucugg

SEQ ID NO: 6145 - RNA, 18 nt, Homo Sapiens
aggcggcgggauuccggg

SEQ ID NO: 6146 - RNA, 19 nt, Homo Sapiens
agggggcccggagacaggg

SEQ ID NO: 6147 - RNA, 22 nt, Homo Sapiens
aggagcgcccgccuuccggguc

SEQ ID NO: 6148 - RNA, 22 nt, Homo Sapiens
agggggcugcugguuccggguc

SEQ ID NO: 6149 - RNA, 19 nt, Homo Sapiens
gcccacuggauuccggguc

SEQ ID NO: 6150 - RNA, 20 nt, Homo Sapiens
ggggccccgcacgcuucggg

SEQ ID NO: 6151 - RNA, 20 nt, Homo Sapiens
ggggccccggcucucgcggg

SEQ ID NO: 6152 - RNA, 18 nt, Homo Sapiens
ggggccccgcucgggguc

SEQ ID NO: 6153 - RNA, 19 nt, Homo Sapiens
ggggccccggagccgguuc

SEQ ID NO: 6154 - RNA, 20 nt, Homo Sapiens
gggggccccacggucuccgg

SEQ ID NO: 6155 - RNA, 21 nt, Homo Sapiens
gggggccccagggagggcggg

SEQ ID NO: 6156 - RNA, 19 nt, Homo Sapiens
gggggccccuggauccagg

SEQ ID NO: 6157 - RNA, 16 nt, Homo Sapiens
gggggccccuucccgg

SEQ ID NO: 6158 - RNA, 18 nt, Homo Sapiens
gggggccccagagccggg

SEQ ID NO: 6159 - RNA, 20 nt, Homo Sapiens
gggggccccgcagccccggu

SEQ ID NO: 6160 - RNA, 19 nt, Homo Sapiens
uaagggaugcggccccgga

SEQ ID NO: 6161 - RNA, 87 nt, Homo Sapiens
gguuuucaaggugucaugaaaagauggggauuuaaaggccagccugcuacgcauggucaaacgaaaacccacaggagaccuggagcu

SEQ ID NO: 6162 - RNA, 24 nt, Homo Sapiens
ugaaaagauggggauuuaaaggcc

SEQ ID NO: 6163 - RNA, 24 nt, Homo Sapiens
aaaaguggugcauuuuuaaaggcc

SEQ ID NO: 6164 - RNA, 21 nt, Homo Sapiens
aaaugaugcaauauuuaaagg

SEQ ID NO: 6165 - RNA, 21 nt, Homo Sapiens
aaaagauggauaucuuaaagg

SEQ ID NO: 6166 - RNA, 16 nt, Homo Sapiens
aaaagauggcgaaaag

SEQ ID NO: 6167 - RNA, 20 nt, Homo Sapiens
aaaaggugaaauuuaaaggc

SEQ ID NO: 6168 - RNA, 22 nt, Homo Sapiens
aaagaggaaggauuuuaaaggc

SEQ ID NO: 6169 - RNA, 17 nt, Homo Sapiens
aaaaaugauuuaaaggc

SEQ ID NO: 6170 - RNA, 20 nt, Homo Sapiens
aagcugggggauuuaagggc

SEQ ID NO: 6171 - RNA, 19 nt, Homo Sapiens
gaagaagauggggaaaagg

SEQ ID NO: 6172 - RNA, 22 nt, Homo Sapiens
gaagaauauggggauuaauagg

SEQ ID NO: 6173 - RNA, 24 nt, Homo Sapiens
gaaaagacugaggaagauuuaaag

SEQ ID NO: 6174 - RNA, 24 nt, Homo Sapiens
gaaaagauggagaaggagucaaag

SEQ ID NO: 6175 - RNA, 18 nt, Homo Sapiens
gaaaagauggaauguaaa

SEQ ID NO: 6176 - RNA, 19 nt, Homo Sapiens
gaaaagaucuggauuuaaa

SEQ ID NO: 6177 - RNA, 18 nt, Homo Sapiens
gaauaauggggauuaaaa

SEQ ID NO: 6178 - RNA, 21 nt, Homo Sapiens
gaaaagaugaggaggaaaagg

SEQ ID NO: 6179 - RNA, 21 nt, Homo Sapiens
gaaaagauggugagugaaggg

SEQ ID NO: 6180 - RNA, 19 nt, Homo Sapiens
gagaagaugggguuacagg

SEQ ID NO: 6181 - RNA, 24 nt, Homo Sapiens
ugaaugagauggggaaaaaaaugc

SEQ ID NO: 6182 - RNA, 24 nt, Homo Sapiens
ugaauagaucuauguggauuuaaa

SEQ ID NO: 6183 - RNA, 19 nt, Homo Sapiens
ugaaaagaugcugaauuua

SEQ ID NO: 6184 - RNA, 17 nt, Homo Sapiens
ugaaaagaugaauuaaa

SEQ ID NO: 6185 - RNA, 21 nt, Homo Sapiens
ugaaaagauuuguuuuuaaag

SEQ ID NO: 6186 - RNA, 21 nt, Homo Sapiens
uggaaaacuggggauuuauag

SEQ ID NO: 6187 - RNA, 19 nt, Homo Sapiens
ugaaaagauguaguaaagg

SEQ ID NO: 6188 - RNA, 20 nt, Homo Sapiens
ugaaaagggauuuaauugcc

SEQ ID NO: 6189 - RNA, 61 nt, Homo Sapiens
gguuuuucuaugagaugagaauuaugaacacuucauauagguaaauuccauagguugagcu

SEQ ID NO: 6190 - RNA, 24 nt, Homo Sapiens
uauagguaaauuccauagguugag

SEQ ID NO: 6191 - RNA, 22 nt, Homo Sapiens
aggaaaucauuccauaggcuga

SEQ ID NO: 6192 - RNA, 20 nt, Homo Sapiens
auauguaaauuccuuugguu

SEQ ID NO: 6193 - RNA, 19 nt, Homo Sapiens
uauacgauaaauuccaagg

SEQ ID NO: 6194 - RNA, 26 nt, Homo Sapiens
uauagguaaaaacuugcauauuuuga

SEQ ID NO: 6195 - RNA, 21 nt, Homo Sapiens
uauagguaaaauauauuuguu

SEQ ID NO: 6196 - RNA, 20 nt, Homo Sapiens
uauggaaaaauuccauguug

SEQ ID NO: 6197 - RNA, 63 nt, Homo Sapiens
guacagauuuuuauaaaaucaucuauacagaugaaguacaaauuuuuauaaaauaaucuauac

SEQ ID NO: 6198 - RNA, 24 nt, Homo Sapiens
ugaaguacaaauuuuuauaaaaua

SEQ ID NO: 6199 - RNA, 22 nt, Homo Sapiens
ugaaauaaaauuuuuaauaaaa

SEQ ID NO: 6200 - RNA, 20 nt, Homo Sapiens
ugaaguacaaagucugaaaa

SEQ ID NO: 6201 - RNA, 100 nt, Homo Sapiens
guaccaggccaguuauaaccagagcuuuucuagucagccucaccaaguagaacaaacagagcuucagcaagaacagcuucaaacagugguuggcacuuac

SEQ ID NO: 6202 - RNA, 24 nt, Homo Sapiens
uaaccagagcuuuucuagucagcc

SEQ ID NO: 6203 - RNA, 25 nt, Homo Sapiens
aaccagagcaacauuuuaauaguca

SEQ ID NO: 6204 - RNA, 23 nt, Homo Sapiens
aaucagagcuuuuuacuauuuag

SEQ ID NO: 6205 - RNA, 18 nt, Homo Sapiens
cagagcuuuuaaagcagc

SEQ ID NO: 6206 - RNA, 19 nt, Homo Sapiens
ccagagcuuuucuagacag

SEQ ID NO: 6207 - RNA, 17 nt, Homo Sapiens
ccagagaucuagucagc

SEQ ID NO: 6208 - RNA, 17 nt, Homo Sapiens
ccagagcuuuuuucagc

SEQ ID NO: 6209 - RNA, 21 nt, Homo Sapiens
uaaccagaaucagcuuuucua

SEQ ID NO: 6210 - RNA, 75 nt, Homo Sapiens
guacggcguguccucccugcagcgcggcguggccgacuacaugcgcgcgcaccuggcgggaggcgcgggcccggc

SEQ ID NO: 6211 - RNA, 24 nt, Homo Sapiens
ugcgcgcgcaccuggcgggaggcg

SEQ ID NO: 6212 - RNA, 19 nt, Homo Sapiens
caccugaacccgggaggcg

SEQ ID NO: 6213 - RNA, 19 nt, Homo Sapiens
cacuugggcccgggaggcg

SEQ ID NO: 6214 - RNA, 21 nt, Homo Sapiens
ccucccucugcagcgccggcg

SEQ ID NO: 6215 - RNA, 24 nt, Homo Sapiens
ccucccugccuccuggcggcgugg

SEQ ID NO: 6216 - RNA, 18 nt, Homo Sapiens
ccuccugcagcgcaggcg

SEQ ID NO: 6217 - RNA, 20 nt, Homo Sapiens
ccccccugcagcgagugugg

SEQ ID NO: 6218 - RNA, 20 nt, Homo Sapiens
ccucccugcagcgguggugg

SEQ ID NO: 6219 - RNA, 17 nt, Homo Sapiens
cgcgaacccgggaggcg

SEQ ID NO: 6220 - RNA, 18 nt, Homo Sapiens
cgggcaccccgggaggcg

SEQ ID NO: 6221 - RNA, 24 nt, Homo Sapiens
cgcucacauuccuggcgggcggcg

SEQ ID NO: 6222 - RNA, 19 nt, Homo Sapiens
cgcgggaccuggcgggagg

SEQ ID NO: 6223 - RNA, 21 nt, Homo Sapiens
cgcgcgcaccgccgcggggcg

SEQ ID NO: 6224 - RNA, 18 nt, Homo Sapiens
cuccgcgcgcgcggcgug

SEQ ID NO: 6225 - RNA, 18 nt, Homo Sapiens
cucugugcgcgcggcgug

SEQ ID NO: 6226 - RNA, 20 nt, Homo Sapiens
gcgcccagcgaggcgggagg

SEQ ID NO: 6227 - RNA, 20 nt, Homo Sapiens
gcucgcccagagcgggaggc

SEQ ID NO: 6228 - RNA, 24 nt, Homo Sapiens
gcgaggagcugggggcgggaggcg

SEQ ID NO: 6229 - RNA, 18 nt, Homo Sapiens
gcgcggcccggcgggagg

SEQ ID NO: 6230 - RNA, 18 nt, Homo Sapiens
gcgugaacccgggaggcg

SEQ ID NO: 6231 - RNA, 24 nt, Homo Sapiens
gcgcgcgcaugcgcgcgggggacg

SEQ ID NO: 6232 - RNA, 24 nt, Homo Sapiens
gcgggagcacgcgcgggcgggagg

SEQ ID NO: 6233 - RNA, 22 nt, Homo Sapiens
gcgcucgcccacgggcgggagg

SEQ ID NO: 6234 - RNA, 20 nt, Homo Sapiens
gcgcgcgcacacucggaggc

SEQ ID NO: 6235 - RNA, 24 nt, Homo Sapiens
gcgugcgugccguguggcgggagg

SEQ ID NO: 6236 - RNA, 22 nt, Homo Sapiens
gcacggccccguggcgggaggc

SEQ ID NO: 6237 - RNA, 23 nt, Homo Sapiens
gcgcgcgcaacagagcgagggcg

SEQ ID NO: 6238 - RNA, 23 nt, Homo Sapiens
gcgcgggcccuggucgggaggcg

SEQ ID NO: 6239 - RNA, 18 nt, Homo Sapiens
gcgcgcgcaggcggcagg

SEQ ID NO: 6240 - RNA, 21 nt, Homo Sapiens
gcgggcgcauggggcgggagg

SEQ ID NO: 6241 - RNA, 22 nt, Homo Sapiens
gcgcgcgcacgucggggcacgc

SEQ ID NO: 6242 - RNA, 22 nt, Homo Sapiens
gcccgcgcaccuccgggucgcg

SEQ ID NO: 6243 - RNA, 20 nt, Homo Sapiens
gcgcgcgcaggaggggggcg

SEQ ID NO: 6244 - RNA, 19 nt, Homo Sapiens
gucgcuccccagcgcggcg

SEQ ID NO: 6245 - RNA, 22 nt, Homo Sapiens
guccucccugggccccucggcg

SEQ ID NO: 6246 - RNA, 23 nt, Homo Sapiens
gucccacuggcagcgcggggagg

SEQ ID NO: 6247 - RNA, 25 nt, Homo Sapiens
uccugagcucugcagcgcugggugg

SEQ ID NO: 6248 - RNA, 19 nt, Homo Sapiens
uccucccugcgcuugcggc

SEQ ID NO: 6249 - RNA, 19 nt, Homo Sapiens
uccucccugccgcugcagc

SEQ ID NO: 6250 - RNA, 23 nt, Homo Sapiens
uccucccugacgcugagccgugg

SEQ ID NO: 6251 - RNA, 20 nt, Homo Sapiens
uccucccgguggcggcgugg

SEQ ID NO: 6252 - RNA, 22 nt, Homo Sapiens
uccucccugcaauggugcaugg

SEQ ID NO: 6253 - RNA, 22 nt, Homo Sapiens
ugcgcgcgccgcccgcgccgga

SEQ ID NO: 6254 - RNA, 25 nt, Homo Sapiens
ugggcgcgcaccgggaccggcggcg

SEQ ID NO: 6255 - RNA, 24 nt, Homo Sapiens
ugugcgcgcaccgggcccagggag

SEQ ID NO: 6256 - RNA, 19 nt, Homo Sapiens
ugcgcucgcacuggcggga

SEQ ID NO: 6257 - RNA, 21 nt, Homo Sapiens
ugcgcgcgcagccguuggaag

SEQ ID NO: 6258 - RNA, 24 nt, Homo Sapiens
ugcccugcuccgcagcgcggacgu

SEQ ID NO: 6259 - RNA, 27 nt, Homo Sapiens
uguccucccuggcccagcucugggugg

SEQ ID NO: 6260 - RNA, 19 nt, Homo Sapiens
ugaccuccugcagcgaggc

SEQ ID NO: 6261 - RNA, 20 nt, Homo Sapiens
uguccucccuaggggcggcg

SEQ ID NO: 6262 - RNA, 67 nt, Homo Sapiens
guagagcuuuaugcugaaaagguggccacuagaggucugugugccauugcccaggcagagucucugc

SEQ ID NO: 6263 - RNA, 24 nt, Homo Sapiens
gugugccauugcccaggcagaguc

SEQ ID NO: 6264 - RNA, 18 nt, Homo Sapiens
auugcccaggcuagucuc

SEQ ID NO: 6265 - RNA, 18 nt, Homo Sapiens
auugcccaggcuggucuc

SEQ ID NO: 6266 - RNA, 19 nt, Homo Sapiens
cauggccgaagcagagucu

SEQ ID NO: 6267 - RNA, 19 nt, Homo Sapiens
cauugcccaggcugaucuc

SEQ ID NO: 6268 - RNA, 19 nt, Homo Sapiens
gccuuugccuccaggcaga

SEQ ID NO: 6269 - RNA, 24 nt, Homo Sapiens
gugccauugcgccccagccugggu

SEQ ID NO: 6270 - RNA, 19 nt, Homo Sapiens
gugccacggcccaggcaga

SEQ ID NO: 6271 - RNA, 18 nt, Homo Sapiens
gugcuuguccaggcagag

SEQ ID NO: 6272 - RNA, 22 nt, Homo Sapiens
guggcagugacggggcagaguc

SEQ ID NO: 6273 - RNA, 22 nt, Homo Sapiens
guggccauugccaaagacugag

SEQ ID NO: 6274 - RNA, 25 nt, Homo Sapiens
guguggauuugcccaggccagacuc

SEQ ID NO: 6275 - RNA, 19 nt, Homo Sapiens
guggccauugcccacccag

SEQ ID NO: 6276 - RNA, 19 nt, Homo Sapiens
gugcgccugccaggcagag

SEQ ID NO: 6277 - RNA, 18 nt, Homo Sapiens
gugugacuucaggcagag

SEQ ID NO: 6278 - RNA, 22 nt, Homo Sapiens
ugccauguugcccaggcugguc

SEQ ID NO: 6279 - RNA, 23 nt, Homo Sapiens
ugccauguugcccaggcuggucu

SEQ ID NO: 6280 - RNA, 24 nt, Homo Sapiens
ugcuaugcugcccaggcuggucuc

SEQ ID NO: 6281 - RNA, 24 nt, Homo Sapiens
ugucauugcccaaagcugauucuc

SEQ ID NO: 6282 - RNA, 18 nt, Homo Sapiens
ugccauugcaagacacag

SEQ ID NO: 6283 - RNA, 20 nt, Homo Sapiens
ugccgccgcgcaggcagagu

SEQ ID NO: 6284 - RNA, 21 nt, Homo Sapiens
ugugccaggaggcccaggcag

SEQ ID NO: 6285 - RNA, 20 nt, Homo Sapiens
ugugccacggcccaggcaga

SEQ ID NO: 6286 - RNA, 19 nt, Homo Sapiens
ugugcuuguccaggcagag

SEQ ID NO: 6287 - RNA, 20 nt, Homo Sapiens
uguguugcccaggcuguguc

SEQ ID NO: 6288 - RNA, 19 nt, Homo Sapiens
uugcccaggccagacucuc

SEQ ID NO: 6289 - RNA, 121 nt, Homo Sapiens
guagaggaagaugagcuuggcguacaacuccuccuccagcuccagcucccgagucucccgcaccaggaagauguccuggcagagcuugaggaugcgguccacgcacggcagcuccucgaac

SEQ ID NO: 6290 - RNA, 24 nt, Homo Sapiens
uguccuggcagagcuugaggaugc

SEQ ID NO: 6291 - RNA, 21 nt, Homo Sapiens
ccuggcagagugggagagaug

SEQ ID NO: 6292 - RNA, 22 nt, Homo Sapiens
cugggcacagaacugaggaugc

SEQ ID NO: 6293 - RNA, 21 nt, Homo Sapiens
cuggcagaggccugaagcugc

SEQ ID NO: 6294 - RNA, 28 nt, Homo Sapiens
guccuggcaggccagcuuccaagcaugc

SEQ ID NO: 6295 - RNA, 21 nt, Homo Sapiens
gucagggcagagcuguaagga

SEQ ID NO: 6296 - RNA, 21 nt, Homo Sapiens
guccuggcacagauuccagga

SEQ ID NO: 6297 - RNA, 19 nt, Homo Sapiens
guccuggcagagcuggggg

SEQ ID NO: 6298 - RNA, 20 nt, Homo Sapiens
guccaguaagagcuugagga

SEQ ID NO: 6299 - RNA, 21 nt, Homo Sapiens
uccuggcagaggccuagugga

SEQ ID NO: 6300 - RNA, 18 nt, Homo Sapiens
uccuggcagugcucagga

SEQ ID NO: 6301 - RNA, 18 nt, Homo Sapiens
uccuggcagugccuggga

SEQ ID NO: 6302 - RNA, 21 nt, Homo Sapiens
uguccuggcacuggccugagg

SEQ ID NO: 6303 - RNA, 21 nt, Homo Sapiens
ugcccuggcagagugagggug

SEQ ID NO: 6304 - RNA, 81 nt, Homo Sapiens
guauacuguuaucucccagggcacccagugcaaggcucuuuaucucaucccgcuuggguguaccugguuacccucagugac

SEQ ID NO: 6305 - RNA, 24 nt, Homo Sapiens
ucccagggcacccagugcaaggcu

SEQ ID NO: 6306 - RNA, 17 nt, Homo Sapiens
cagggcaccaagcaagg

SEQ ID NO: 6307 - RNA, 22 nt, Homo Sapiens
ccagggcacuucccaggugcaa

SEQ ID NO: 6308 - RNA, 20 nt, Homo Sapiens
cccagggcacgcguccuagg

SEQ ID NO: 6309 - RNA, 20 nt, Homo Sapiens
ucccagggcccggggcaagg

SEQ ID NO: 6310 - RNA, 20 nt, Homo Sapiens
ucccugggcucugcaaggcu

SEQ ID NO: 6311 - RNA, 85 nt, Homo Sapiens
guaucgacggagcauguacagggaggcaugcaccgcaguggugaauacacgucgagcugcaagcauucacugcaugcucugguac

SEQ ID NO: 6312 - RNA, 24 nt, Homo Sapiens
uguacagggaggcaugcaccgcag

SEQ ID NO: 6313 - RNA, 22 nt, Homo Sapiens
acagggagggaggaugcaaccg

SEQ ID NO: 6314 - RNA, 22 nt, Homo Sapiens
acagggggccugugcaccgcag

SEQ ID NO: 6315 - RNA, 17 nt, Homo Sapiens
acagggaggcgcaucgc

SEQ ID NO: 6316 - RNA, 18 nt, Homo Sapiens
acagggaggcugguccgc

SEQ ID NO: 6317 - RNA, 18 nt, Homo Sapiens
acagggaggcaucacggc

SEQ ID NO: 6318 - RNA, 18 nt, Homo Sapiens
acagggaggcaacagcag

SEQ ID NO: 6319 - RNA, 20 nt, Homo Sapiens
acagggagggaggcaggcag

SEQ ID NO: 6320 - RNA, 21 nt, Homo Sapiens
cagggaggcauggcucacagc

SEQ ID NO: 6321 - RNA, 20 nt, Homo Sapiens
cagggaggcaggcaggccgc

SEQ ID NO: 6322 - RNA, 19 nt, Homo Sapiens
cagggaggcaggcgcccca

SEQ ID NO: 6323 - RNA, 19 nt, Homo Sapiens
cagggaggccggcacccca

SEQ ID NO: 6324 - RNA, 19 nt, Homo Sapiens
cacggccgcagcaccgcag

SEQ ID NO: 6325 - RNA, 20 nt, Homo Sapiens
guacagggaaaccugcgccg

SEQ ID NO: 6326 - RNA, 21 nt, Homo Sapiens
uguaacagggaggcaguugca

SEQ ID NO: 6327 - RNA, 19 nt, Homo Sapiens
uguacagggugccacugca

SEQ ID NO: 6328 - RNA, 19 nt, Homo Sapiens
uguacagggugggcacagc

SEQ ID NO: 6329 - RNA, 62 nt, Homo Sapiens
guaugaaagggggaaacaaagaacagccuuuuagguaaggcuuuucaguaccugccucgugc

SEQ ID NO: 6330 - RNA, 24 nt, Homo Sapiens
ugaaagggggaaacaaagaacagc

SEQ ID NO: 6331 - RNA, 20 nt, Homo Sapiens
aaacagggaaacaaauaaca

SEQ ID NO: 6332 - RNA, 22 nt, Homo Sapiens
aaaagggacuacaaagaacagc

SEQ ID NO: 6333 - RNA, 23 nt, Homo Sapiens
aagggagcuacagaaagaacagc

SEQ ID NO: 6334 - RNA, 21 nt, Homo Sapiens
aagggggaaaaaaggaaacag

SEQ ID NO: 6335 - RNA, 21 nt, Homo Sapiens
aagggggaaaaaaaaaaucag

SEQ ID NO: 6336 - RNA, 18 nt, Homo Sapiens
aagggggaaaaaagauca

SEQ ID NO: 6337 - RNA, 20 nt, Homo Sapiens
aagggggaaaaaaaaaaaag

SEQ ID NO: 6338 - RNA, 20 nt, Homo Sapiens
aagggggaaagaaagaaaag

SEQ ID NO: 6339 - RNA, 21 nt, Homo Sapiens
aggggacgugacaaagaacag

SEQ ID NO: 6340 - RNA, 19 nt, Homo Sapiens
agugggaaacaaagugcag

SEQ ID NO: 6341 - RNA, 22 nt, Homo Sapiens
gaauagggggaaagcacaagaa

SEQ ID NO: 6342 - RNA, 20 nt, Homo Sapiens
gaaauggugggaaacaaaga

SEQ ID NO: 6343 - RNA, 25 nt, Homo Sapiens
gaagggguuggaaacaaaagagcag

SEQ ID NO: 6344 - RNA, 23 nt, Homo Sapiens
gaaagggggauagcagagacaca

SEQ ID NO: 6345 - RNA, 21 nt, Homo Sapiens
gagagggggaaaaagucaaag

SEQ ID NO: 6346 - RNA, 24 nt, Homo Sapiens
gaaaggggggaucuaaauaacugc

SEQ ID NO: 6347 - RNA, 19 nt, Homo Sapiens
gaaagcaggaacaaagaac

SEQ ID NO: 6348 - RNA, 22 nt, Homo Sapiens
gaaagaaagaaacaaagaaaag

SEQ ID NO: 6349 - RNA, 23 nt, Homo Sapiens
gggggacagaacaaagaaccagc

SEQ ID NO: 6350 - RNA, 27 nt, Homo Sapiens
ugagaagggcuccaaaaaaagaacagc

SEQ ID NO: 6351 - RNA, 21 nt, Homo Sapiens
uggaagggggaaagagcaaag

SEQ ID NO: 6352 - RNA, 28 nt, Homo Sapiens
uggaugguggaaacaaaggagaaacagc

SEQ ID NO: 6353 - RNA, 16 nt, Homo Sapiens
ugaagggaaacaaaga

SEQ ID NO: 6354 - RNA, 19 nt, Homo Sapiens
ugaaaagaggaaacaaaga

SEQ ID NO: 6355 - RNA, 20 nt, Homo Sapiens
ugaaaaaaagaaacaaagaa

SEQ ID NO: 6356 - RNA, 19 nt, Homo Sapiens
ugaaaaggaacaaagaaca

SEQ ID NO: 6357 - RNA, 83 nt, Homo Sapiens
gucaagagaaucaaauuugcucuuuacaggugcugggucaaagucuucccgguuggagucaagaucagaauagcuccucuugc

SEQ ID NO: 6358 - RNA, 24 nt, Homo Sapiens
ucaaauuugcucuuuacaggugcu

SEQ ID NO: 6359 - RNA, 19 nt, Homo Sapiens
aaauuacuucucuuuacag

SEQ ID NO: 6360 - RNA, 27 nt, Homo Sapiens
aaauuugcuuugcauuuuaacaggugc

SEQ ID NO: 6361 - RNA, 19 nt, Homo Sapiens
aaauuugcuuuguucaggu

SEQ ID NO: 6362 - RNA, 19 nt, Homo Sapiens
aaaauuguuuacaggugcu

SEQ ID NO: 6363 - RNA, 21 nt, Homo Sapiens
caaaucauuccuucuuuacag

SEQ ID NO: 6364 - RNA, 19 nt, Homo Sapiens
caaguguuguucuuuacag

SEQ ID NO: 6365 - RNA, 18 nt, Homo Sapiens
caaacugaucuuuacagg

SEQ ID NO: 6366 - RNA, 21 nt, Homo Sapiens
ucaaaaauacuacuuuacagg

SEQ ID NO: 6367 - RNA, 21 nt, Homo Sapiens
uccauuuugcucuucuccagg

SEQ ID NO: 6368 - RNA, 24 nt, Homo Sapiens
ucuacuuugcucuugagggcaggu

SEQ ID NO: 6369 - RNA, 18 nt, Homo Sapiens
ucaaccuucucuuuacag

SEQ ID NO: 6370 - RNA, 21 nt, Homo Sapiens
ucaaacaagcuuuuacaggug

SEQ ID NO: 6371 - RNA, 22 nt, Homo Sapiens
ugcucuguuucuuacaggugcu

SEQ ID NO: 6372 - RNA, 73 nt, Homo Sapiens
gucaugugaugcucaaucagcaaaccagggauuggcuucauccugggaaaaagcuaucugggugcaacaagac

SEQ ID NO: 6373 - RNA, 24 nt, Homo Sapiens
ugugaugcucaaucagcaaaccag

SEQ ID NO: 6374 - RNA, 20 nt, Homo Sapiens
gugaagugcucaaucugaaa

SEQ ID NO: 6375 - RNA, 20 nt, Homo Sapiens
gugaaugcccucagcaaacc

SEQ ID NO: 6376 - RNA, 18 nt, Homo Sapiens
gugaguucucagcaaacc

SEQ ID NO: 6377 - RNA, 19 nt, Homo Sapiens
ugcaccaccggcaaaccag

SEQ ID NO: 6378 - RNA, 24 nt, Homo Sapiens
ugugaagcuuaugcccagcaaacc

SEQ ID NO: 6379 - RNA, 20 nt, Homo Sapiens
ugugauccaaagcaaaccag

SEQ ID NO: 6380 - RNA, 90 nt, Homo Sapiens
gucccucccuccccugcugugaccuuguggggguugagaaaccuaggcacucauggcccccuggaggggcagggcaggcagggcuggggc

SEQ ID NO: 6381 - RNA, 24 nt, Homo Sapiens
uggcccccuggaggggcagggcag

SEQ ID NO: 6382 - RNA, 23 nt, Homo Sapiens
cccucuggccaggggcagggcag

SEQ ID NO: 6383 - RNA, 19 nt, Homo Sapiens
cccccuggagggcccuggc

SEQ ID NO: 6384 - RNA, 21 nt, Homo Sapiens
ccucuggaguggggcagggca

SEQ ID NO: 6385 - RNA, 19 nt, Homo Sapiens
cccgggaggggcagaggca

SEQ ID NO: 6386 - RNA, 19 nt, Homo Sapiens
ccuggagggacauggggag

SEQ ID NO: 6387 - RNA, 23 nt, Homo Sapiens
gcccaugggaggggggcagggca

SEQ ID NO: 6388 - RNA, 19 nt, Homo Sapiens
gcccccuggcagggcuggg

SEQ ID NO: 6389 - RNA, 20 nt, Homo Sapiens
gcccccuggagggggcgggc

SEQ ID NO: 6390 - RNA, 20 nt, Homo Sapiens
gcccccuggaagcaagacag

SEQ ID NO: 6391 - RNA, 22 nt, Homo Sapiens
gccccgggguggggcaggggag

SEQ ID NO: 6392 - RNA, 27 nt, Homo Sapiens
ggcccucccaggaggggcagcuggcag

SEQ ID NO: 6393 - RNA, 19 nt, Homo Sapiens
ggcucaccuggaggggcag

SEQ ID NO: 6394 - RNA, 21 nt, Homo Sapiens
ggcucccguugcaggggcagg

SEQ ID NO: 6395 - RNA, 24 nt, Homo Sapiens
gggccugugagagaggcagggcag

SEQ ID NO: 6396 - RNA, 22 nt, Homo Sapiens
ggccuccugggcaaggggcagg

SEQ ID NO: 6397 - RNA, 22 nt, Homo Sapiens
ggccccgugggugggggcaggg

SEQ ID NO: 6398 - RNA, 21 nt, Homo Sapiens
ggccccagggagggggcaggg

SEQ ID NO: 6399 - RNA, 23 nt, Homo Sapiens
ggcccccuggaggaugcgggcag

SEQ ID NO: 6400 - RNA, 23 nt, Homo Sapiens
ggcccccuggagggccagcaggg

SEQ ID NO: 6401 - RNA, 22 nt, Homo Sapiens
ggucaccuggagggaguagggc

SEQ ID NO: 6402 - RNA, 22 nt, Homo Sapiens
ggcccccuggggggguacaggg

SEQ ID NO: 6403 - RNA, 20 nt, Homo Sapiens
gguccccuggagggacaugg

SEQ ID NO: 6404 - RNA, 22 nt, Homo Sapiens
ggccacaugaaggggcagggca

SEQ ID NO: 6405 - RNA, 22 nt, Homo Sapiens
ggcacccuggaggggaggggag

SEQ ID NO: 6406 - RNA, 19 nt, Homo Sapiens
ggccaccugggcagggcag

SEQ ID NO: 6407 - RNA, 20 nt, Homo Sapiens
ggcccccgagggcagggcag

SEQ ID NO: 6408 - RNA, 23 nt, Homo Sapiens
ggccuucugggggugcagggcag

SEQ ID NO: 6409 - RNA, 23 nt, Homo Sapiens
uggccucccuggaggcagagggc

SEQ ID NO: 6410 - RNA, 26 nt, Homo Sapiens
ugggccaggccuguguggggcagggc

SEQ ID NO: 6411 - RNA, 25 nt, Homo Sapiens
uggcccaguccugggggcaggggag

SEQ ID NO: 6412 - RNA, 19 nt, Homo Sapiens
ugggccccuaggaggggca

SEQ ID NO: 6413 - RNA, 28 nt, Homo Sapiens
ugcccaucuggacaauggggcagggcag

SEQ ID NO: 6414 - RNA, 25 nt, Homo Sapiens
uggcccaggggacggggcaggggag

SEQ ID NO: 6415 - RNA, 19 nt, Homo Sapiens
ugaccaucuugaggggcag

SEQ ID NO: 6416 - RNA, 22 nt, Homo Sapiens
ugcccgccuggaggggccgggc

SEQ ID NO: 6417 - RNA, 20 nt, Homo Sapiens
uggccccaagggcagggcag

SEQ ID NO: 6418 - RNA, 24 nt, Homo Sapiens
uggccccgcgccggggcagggaag

SEQ ID NO: 6419 - RNA, 61 nt, Homo Sapiens
guccuuucuuucgccaggcuggggacccgcuucgcguuaucauccuggucgcagggaaggc

SEQ ID NO: 6420 - RNA, 24 nt, Homo Sapiens
uaucauccuggucgcagggaaggc

SEQ ID NO: 6421 - RNA, 23 nt, Homo Sapiens
aucaucuuuggacugcagggaag

SEQ ID NO: 6422 - RNA, 18 nt, Homo Sapiens
aucauccuggggcagaga

SEQ ID NO: 6423 - RNA, 19 nt, Homo Sapiens
caucacaggcgcagggaag

SEQ ID NO: 6424 - RNA, 19 nt, Homo Sapiens
cagcccuguccagggaagg

SEQ ID NO: 6425 - RNA, 19 nt, Homo Sapiens
caugguggggcagggaagg

SEQ ID NO: 6426 - RNA, 21 nt, Homo Sapiens
ucaguccugcuggcagggaag

SEQ ID NO: 6427 - RNA, 19 nt, Homo Sapiens
ucauccugggcgugcaggg

SEQ ID NO: 6428 - RNA, 22 nt, Homo Sapiens
ucauccucugcaggcagggaag

SEQ ID NO: 6429 - RNA, 23 nt, Homo Sapiens
uccuucgggucggccagggaagg

SEQ ID NO: 6430 - RNA, 21 nt, Homo Sapiens
ucagcccgcacucagggaagg

SEQ ID NO: 6431 - RNA, 20 nt, Homo Sapiens
ucauccugggcuaggcaggc

SEQ ID NO: 6432 - RNA, 19 nt, Homo Sapiens
uccugcgccucagggaagg

SEQ ID NO: 6433 - RNA, 22 nt, Homo Sapiens
uccuggcugggucagggaaggc

SEQ ID NO: 6434 - RNA, 21 nt, Homo Sapiens
uccuggagaggcagggaaggc

SEQ ID NO: 6435 - RNA, 21 nt, Homo Sapiens
uccugggcuagaagggaaggc

SEQ ID NO: 6436 - RNA, 75 nt, Homo Sapiens
gucucacacaugacaugugaaaaucugacucaaaguucuuuaucuugaagcuguguuuauauguuccgugugcac

SEQ ID NO: 6437 - RNA, 24 nt, Homo Sapiens
ugacaugugaaaaucugacucaaa

SEQ ID NO: 6438 - RNA, 19 nt, Homo Sapiens
acaugaaggaaaaucugac

SEQ ID NO: 6439 - RNA, 24 nt, Homo Sapiens
acaugugaaaaauauggaacucaa

SEQ ID NO: 6440 - RNA, 21 nt, Homo Sapiens
acaugugaaauucuaaugacu

SEQ ID NO: 6441 - RNA, 23 nt, Homo Sapiens
acauucaaaaaucugacauuaaa

SEQ ID NO: 6442 - RNA, 18 nt, Homo Sapiens
acagagaaaaucuggcuc

SEQ ID NO: 6443 - RNA, 22 nt, Homo Sapiens
acauguaagacacugacucaaa

SEQ ID NO: 6444 - RNA, 22 nt, Homo Sapiens
acuugugaaaauguguuuaaaa

SEQ ID NO: 6445 - RNA, 22 nt, Homo Sapiens
caugugucuuaaaucugacaca

SEQ ID NO: 6446 - RNA, 21 nt, Homo Sapiens
ugacauguguagagucugccu

SEQ ID NO: 6447 - RNA, 17 nt, Homo Sapiens
ugacaagaaaaucugac

SEQ ID NO: 6448 - RNA, 20 nt, Homo Sapiens
ugaaaugugaaaaacccaaa

SEQ ID NO: 6449 - RNA, 21 nt, Homo Sapiens
ugacacaaaaccugacucaaa

SEQ ID NO: 6450 - RNA, 24 nt, Homo Sapiens
ugaccggcgaaaaucugacagaaa

SEQ ID NO: 6451 - RNA, 21 nt, Homo Sapiens
ugugcaaaaaucugauuaaaa

SEQ ID NO: 6452 - RNA, 63 nt, Homo Sapiens
gugacauuaaaacaaggggauauuacccaaaaggggugggugaagugaugguucgaaugucac

SEQ ID NO: 6453 - RNA, 24 nt, Homo Sapiens
ugacauuaaaacaaggggauauua

SEQ ID NO: 6454 - RNA, 21 nt, Homo Sapiens
acauuaaaacuuaagagguua

SEQ ID NO: 6455 - RNA, 22 nt, Homo Sapiens
acauuaaaacucaggugaauau

SEQ ID NO: 6456 - RNA, 21 nt, Homo Sapiens
acauuaaaacauaauggaauu

SEQ ID NO: 6457 - RNA, 24 nt, Homo Sapiens
acauuaaaaaaaauucggagauau

SEQ ID NO: 6458 - RNA, 24 nt, Homo Sapiens
acuuuaaaacaagcgcagguauau

SEQ ID NO: 6459 - RNA, 21 nt, Homo Sapiens
acauuaaaacagggggcauau

SEQ ID NO: 6460 - RNA, 17 nt, Homo Sapiens
acauuaaaaaguggaua

SEQ ID NO: 6461 - RNA, 19 nt, Homo Sapiens
acauuaaaaaggacauauu

SEQ ID NO: 6462 - RNA, 22 nt, Homo Sapiens
acauuaaaagaagacgacuuua

SEQ ID NO: 6463 - RNA, 22 nt, Homo Sapiens
acauuaaaaugcgggaaucuua

SEQ ID NO: 6464 - RNA, 22 nt, Homo Sapiens
auuaaaaaauguagggauauua

SEQ ID NO: 6465 - RNA, 17 nt, Homo Sapiens
auuaaaaagggauauua

SEQ ID NO: 6466 - RNA, 20 nt, Homo Sapiens
auuaaaacaaugaaauacua

SEQ ID NO: 6467 - RNA, 25 nt, Homo Sapiens
gacauuuauaaaacaagugaauauu

SEQ ID NO: 6468 - RNA, 25 nt, Homo Sapiens
gacauuaaaaggcauaggcauauua

SEQ ID NO: 6469 - RNA, 26 nt, Homo Sapiens
gacauuuaaacauguuaggggauauu

SEQ ID NO: 6470 - RNA, 19 nt, Homo Sapiens
uaaacauaaggggauacua

SEQ ID NO: 6471 - RNA, 20 nt, Homo Sapiens
ugacagaaaacaaggcauau

SEQ ID NO: 6472 - RNA, 21 nt, Homo Sapiens
uuaaaacaaagggggcaauua

SEQ ID NO: 6473 - RNA, 18 nt, Homo Sapiens
uuaaaacaauggcauuua

SEQ ID NO: 6474 - RNA, 87 nt, Homo Sapiens
gugaggauggcagugcaggaugcaguagaugcccugaugcagaagugcuuucaacuccucguccuucaacuccaacaccuuccucac

SEQ ID NO: 6475 - RNA, 24 nt, Homo Sapiens
uggcagugcaggaugcaguagaug

SEQ ID NO: 6476 - RNA, 19 nt, Homo Sapiens
cagugcagguuaauucagu

SEQ ID NO: 6477 - RNA, 20 nt, Homo Sapiens
cagugcaggaagaacuauau

SEQ ID NO: 6478 - RNA, 20 nt, Homo Sapiens
cagcccaggaugcaucgaug

SEQ ID NO: 6479 - RNA, 24 nt, Homo Sapiens
gcagugcaggacugaaugucgcug

SEQ ID NO: 6480 - RNA, 23 nt, Homo Sapiens
ggcacggugacagcggaugcagu

SEQ ID NO: 6481 - RNA, 20 nt, Homo Sapiens
ggcacuggcucaggaugcag

SEQ ID NO: 6482 - RNA, 22 nt, Homo Sapiens
gggacugcaggaugucagaaga

SEQ ID NO: 6483 - RNA, 18 nt, Homo Sapiens
ggcagugcaaagcagaag

SEQ ID NO: 6484 - RNA, 18 nt, Homo Sapiens
gguauugcaaugcaguag

SEQ ID NO: 6485 - RNA, 21 nt, Homo Sapiens
ugccaggccauggaugcagua

SEQ ID NO: 6486 - RNA, 19 nt, Homo Sapiens
uggcagugcugaugucagu

SEQ ID NO: 6487 - RNA, 18 nt, Homo Sapiens
uggaaugaaggaugcagu

SEQ ID NO: 6488 - RNA, 18 nt, Homo Sapiens
uggcaggcaggaugcagu

SEQ ID NO: 6489 - RNA, 74 nt, Homo Sapiens
gugaugagcacgacgggacgggcagauccauucaugcaaccgguaugagaucuccuuacccucuguugcaucau

SEQ ID NO: 6490 - RNA, 24 nt, Homo Sapiens
gagaucuccuuacccucuguugca

SEQ ID NO: 6491 - RNA, 22 nt, Homo Sapiens
agaucugcugcccuacccucug

SEQ ID NO: 6492 - RNA, 28 nt, Homo Sapiens
agaucuccuuauacuuccuccuuuguug

SEQ ID NO: 6493 - RNA, 19 nt, Homo Sapiens
agaucuccuccucauugca

SEQ ID NO: 6494 - RNA, 23 nt, Homo Sapiens
aucugucccuuucacccucuguu

SEQ ID NO: 6495 - RNA, 20 nt, Homo Sapiens
aucuuuuucucucuguugca

SEQ ID NO: 6496 - RNA, 20 nt, Homo Sapiens
gaucuauucccuuacccucu

SEQ ID NO: 6497 - RNA, 25 nt, Homo Sapiens
gaucuccuucgacgcuucuauucca

SEQ ID NO: 6498 - RNA, 19 nt, Homo Sapiens
gaccaccuuacccuguuuu

SEQ ID NO: 6499 - RNA, 18 nt, Homo Sapiens
ucuccuugucucuguugc

SEQ ID NO: 6500 - RNA, 79 nt, Homo Sapiens
gugauguccggagauucggagcggcgauaucuggaucuaagucuccgcuccgaugugaagucuaucucugugacaccau

SEQ ID NO: 6501 - RNA, 24 nt, Homo Sapiens
uguccggagauucggagcggcgau

SEQ ID NO: 6502 - RNA, 20 nt, Homo Sapiens
ccggaggauucggaggggcg

SEQ ID NO: 6503 - RNA, 21 nt, Homo Sapiens
ccggggcuacauggagcggcg

SEQ ID NO: 6504 - RNA, 17 nt, Homo Sapiens
ccggguucggagcgucg

SEQ ID NO: 6505 - RNA, 19 nt, Homo Sapiens
cggagguggcagcggcgau

SEQ ID NO: 6506 - RNA, 19 nt, Homo Sapiens
ggggacucgaggagcggcg

SEQ ID NO: 6507 - RNA, 26 nt, Homo Sapiens
gucuggaagcagucggagagcggcga

SEQ ID NO: 6508 - RNA, 23 nt, Homo Sapiens
uguccggaggaggaggagcugcg

SEQ ID NO: 6509 - RNA, 27 nt, Homo Sapiens
ugugcggagccgauucggagaaggcga

SEQ ID NO: 6510 - RNA, 22 nt, Homo Sapiens
uguccggagcgaacggagggcg

SEQ ID NO: 6511 - RNA, 19 nt, Homo Sapiens
uguccggagggagcaggcg

SEQ ID NO: 6512 - RNA, 19 nt, Homo Sapiens
ugucugguuuucggagcgg

SEQ ID NO: 6513 - RNA, 21 nt, Homo Sapiens
uguccggaggcucgcggcggc

SEQ ID NO: 6514 - RNA, 87 nt, Homo Sapiens
gugccagcgaugaugagauagccaggcugaagaagccagaccaaggcaucaaggggcgaucagccuggucucuaugaagacuggcgc

SEQ ID NO: 6515 - RNA, 24 nt, Homo Sapiens
ugagauagccaggcugaagaagcc

SEQ ID NO: 6516 - RNA, 20 nt, Homo Sapiens
agauagagccaggcuggaga

SEQ ID NO: 6517 - RNA, 19 nt, Homo Sapiens
agaaaggccuggcugaaga

SEQ ID NO: 6518 - RNA, 23 nt, Homo Sapiens
agagagccaagugagcugaagaa

SEQ ID NO: 6519 - RNA, 21 nt, Homo Sapiens
agauaugcagcccugaagaag

SEQ ID NO: 6520 - RNA, 18 nt, Homo Sapiens
agaaggcaggcugaacaa

SEQ ID NO: 6521 - RNA, 17 nt, Homo Sapiens
agauagagcugaagaag

SEQ ID NO: 6522 - RNA, 21 nt, Homo Sapiens
gaguucagccaggcuaaggag

SEQ ID NO: 6523 - RNA, 23 nt, Homo Sapiens
gagguggccacaggcugaaggag

SEQ ID NO: 6524 - RNA, 26 nt, Homo Sapiens
gaggaagccaggcugagccaagaagc

SEQ ID NO: 6525 - RNA, 21 nt, Homo Sapiens
gaaagaccuaggcugaagaag

SEQ ID NO: 6526 - RNA, 23 nt, Homo Sapiens
gauaguuucccaggcugagagaa

SEQ ID NO: 6527 - RNA, 18 nt, Homo Sapiens
ugagaagcacaggcugaa

SEQ ID NO: 6528 - RNA, 21 nt, Homo Sapiens
ugaggucggcuaggcugaaga

SEQ ID NO: 6529 - RNA, 98 nt, Homo Sapiens
gugcuccuuuuugauauagauaaaauauuuaaugcuucuauuuacaucugcucauguagguuuuacaauauuccauguauauccaauguggaugguac

SEQ ID NO: 6530 - RNA, 24 nt, Homo Sapiens
uaaaauauuuaaugcuucuauuua

SEQ ID NO: 6531 - RNA, 23 nt, Homo Sapiens
aaaauaagauuuaaugcuuuauu

SEQ ID NO: 6532 - RNA, 24 nt, Homo Sapiens
aaaacauuuaaugcccucugauuu

SEQ ID NO: 6533 - RNA, 20 nt, Homo Sapiens
aaaauaguugagcuucuauu

SEQ ID NO: 6534 - RNA, 20 nt, Homo Sapiens
aaguaauuaaugcuucauau

SEQ ID NO: 6535 - RNA, 25 nt, Homo Sapiens
uaaagucuuuuaaugcucuuauuua

SEQ ID NO: 6536 - RNA, 27 nt, Homo Sapiens
uaauauauaauaaugcuuccuucuuua

SEQ ID NO: 6537 - RNA, 20 nt, Homo Sapiens
uaaaauauucccauucuucu

SEQ ID NO: 6538 - RNA, 20 nt, Homo Sapiens
uaaaauauuaacauucuucu

SEQ ID NO: 6539 - RNA, 25 nt, Homo Sapiens
uaaaaaauauacacguuucuauuua

SEQ ID NO: 6540 - RNA, 25 nt, Homo Sapiens
uauaauaaauaauacauucuauuua

SEQ ID NO: 6541 - RNA, 24 nt, Homo Sapiens
uaaaauauuuagcacuaucuacuu

SEQ ID NO: 6542 - RNA, 18 nt, Homo Sapiens
uaaaauauuuagcuuuau

SEQ ID NO: 6543 - RNA, 22 nt, Homo Sapiens
uaaaauauuucuugcuuaaauu

SEQ ID NO: 6544 - RNA, 23 nt, Homo Sapiens
uaaaauauuucauuucuccauuu

SEQ ID NO: 6545 - RNA, 23 nt, Homo Sapiens
uaaaguauuuuugcuucuaugua

SEQ ID NO: 6546 - RNA, 22 nt, Homo Sapiens
uauaauauuuaaagcucuuuua

SEQ ID NO: 6547 - RNA, 72 nt, Homo Sapiens
guggagcagauaaccauuguuucucggccgcuaucuggucagaggggagcugggccgggaaauucugccuac

SEQ ID NO: 6548 - RNA, 24 nt, Homo Sapiens
uaaccauuguuucucggccgcuau

SEQ ID NO: 6549 - RNA, 18 nt, Homo Sapiens
ccauuguuuuccgcgcua

SEQ ID NO: 6550 - RNA, 86 nt, Homo Sapiens
guggcacagcuggagaguggggagcugggacuugagcccagguaguguguccccagcaccuucaacuaaacuccauucugugcugc

SEQ ID NO: 6551 - RNA, 24 nt, Homo Sapiens
ccccagcaccuucaacuaaacucc

SEQ ID NO: 6552 - RNA, 19 nt, Homo Sapiens
agcacuucaacuaggcucc

SEQ ID NO: 6553 - RNA, 24 nt, Homo Sapiens
cagcaccuugccucacuaaucucc

SEQ ID NO: 6554 - RNA, 20 nt, Homo Sapiens
cagcaccuucaauugaaacu

SEQ ID NO: 6555 - RNA, 19 nt, Homo Sapiens
cagcaccuuagacagcucc

SEQ ID NO: 6556 - RNA, 21 nt, Homo Sapiens
cagcaccuucuccuggacucc

SEQ ID NO: 6557 - RNA, 18 nt, Homo Sapiens
ccagcaccugccgaaacu

SEQ ID NO: 6558 - RNA, 26 nt, Homo Sapiens
ccccagaacucccuucaacuagucuc

SEQ ID NO: 6559 - RNA, 21 nt, Homo Sapiens
ccccagcaccucucucucaac

SEQ ID NO: 6560 - RNA, 21 nt, Homo Sapiens
ccccaguuucacacuaaacuc

SEQ ID NO: 6561 - RNA, 85 nt, Homo Sapiens
guggcagaagaucccagcugaccacggccccuuucucuggggucagagggagaagacaggcgcagucagcaggggcagcuguugc

SEQ ID NO: 6562 - RNA, 24 nt, Homo Sapiens
ucccagcugaccacggccccuuuc

SEQ ID NO: 6563 - RNA, 21 nt, Homo Sapiens
agcugaccagcuuccucuuuc

SEQ ID NO: 6564 - RNA, 18 nt, Homo Sapiens
agcucagcaggccccuuu

SEQ ID NO: 6565 - RNA, 19 nt, Homo Sapiens
agcagccccagccccuuuc

SEQ ID NO: 6566 - RNA, 24 nt, Homo Sapiens
cagcuggcaccucaggccccuuuc

SEQ ID NO: 6567 - RNA, 20 nt, Homo Sapiens
cagcugaccgcgcgcgccuu

SEQ ID NO: 6568 - RNA, 19 nt, Homo Sapiens
cagcugacccggacccuuu

SEQ ID NO: 6569 - RNA, 20 nt, Homo Sapiens
ccagacucuggccacggccc

SEQ ID NO: 6570 - RNA, 19 nt, Homo Sapiens
ccaggcugaacggccccuu

SEQ ID NO: 6571 - RNA, 21 nt, Homo Sapiens
ccggcagacuaacacggcccc

SEQ ID NO: 6572 - RNA, 18 nt, Homo Sapiens
ccggcgacgcacggcccc

SEQ ID NO: 6573 - RNA, 19 nt, Homo Sapiens
ccagcucccccggccccuu

SEQ ID NO: 6574 - RNA, 20 nt, Homo Sapiens
ccaccacacccggccccuuu

SEQ ID NO: 6575 - RNA, 17 nt, Homo Sapiens
ccagcugaccccccuuu

SEQ ID NO: 6576 - RNA, 18 nt, Homo Sapiens
ccagcaccggccccuuuc

SEQ ID NO: 6577 - RNA, 21 nt, Homo Sapiens
cccaggcugcgcacggccccu

SEQ ID NO: 6578 - RNA, 24 nt, Homo Sapiens
cccagcugaaucaccagcuccuuu

SEQ ID NO: 6579 - RNA, 21 nt, Homo Sapiens
cccagcugaccacgcccgccu

SEQ ID NO: 6580 - RNA, 17 nt, Homo Sapiens
cccagcugaccggcucc

SEQ ID NO: 6581 - RNA, 19 nt, Homo Sapiens
cugaccaucgcggccccuu

SEQ ID NO: 6582 - RNA, 26 nt, Homo Sapiens
ucccugcgucucacacagccccuuuc

SEQ ID NO: 6583 - RNA, 22 nt, Homo Sapiens
ucccagcugagggccaccuccc

SEQ ID NO: 6584 - RNA, 20 nt, Homo Sapiens
ucccagcugugccacggccc

SEQ ID NO: 6585 - RNA, 22 nt, Homo Sapiens
ucccagcuggccaagcgcuccu

SEQ ID NO: 6586 - RNA, 17 nt, Homo Sapiens
ucccagcugcccagccc

SEQ ID NO: 6587 - RNA, 25 nt, Homo Sapiens
ucccagcugcucagucccaacuuuc

SEQ ID NO: 6588 - RNA, 17 nt, Homo Sapiens
ucccaccccacggcccc

SEQ ID NO: 6589 - RNA, 20 nt, Homo Sapiens
ucccagcuggccucuguccc

SEQ ID NO: 6590 - RNA, 22 nt, Homo Sapiens
ucccgccugcgcaggccccuuu

SEQ ID NO: 6591 - RNA, 22 nt, Homo Sapiens
ucccagcugcacggcucaguuc

SEQ ID NO: 6592 - RNA, 24 nt, Homo Sapiens
ucccagcugaccacagccccuuuc

SEQ ID NO: 6593 - RNA, 64 nt, Homo Sapiens
guggcccacgugggcaggacggccgcaggaugggguggcugugcugguccgacaccugggcuac

SEQ ID NO: 6594 - RNA, 24 nt, Homo Sapiens
gugcugguccgacaccugggcuac

SEQ ID NO: 6595 - RNA, 23 nt, Homo Sapiens
gcuggucuggaacuccugggcua

SEQ ID NO: 6596 - RNA, 23 nt, Homo Sapiens
gcuggucuuuaacuccugggcua

SEQ ID NO: 6597 - RNA, 23 nt, Homo Sapiens
gcaggucagagggcaccugggcu

SEQ ID NO: 6598 - RNA, 20 nt, Homo Sapiens
gcgggacccacccugggcua

SEQ ID NO: 6599 - RNA, 22 nt, Homo Sapiens
gcugcuccaucuccugggcuac

SEQ ID NO: 6600 - RNA, 22 nt, Homo Sapiens
gugcuggucaggucacugggcu

SEQ ID NO: 6601 - RNA, 20 nt, Homo Sapiens
gugcuggucagugaacaccu

SEQ ID NO: 6602 - RNA, 20 nt, Homo Sapiens
gugcuggucuguuaacaccu

SEQ ID NO: 6603 - RNA, 18 nt, Homo Sapiens
gugcuguuccaccugggc

SEQ ID NO: 6604 - RNA, 19 nt, Homo Sapiens
gugcugguccacucgcuac

SEQ ID NO: 6605 - RNA, 23 nt, Homo Sapiens
ugcuguggccuacacaccugggc

SEQ ID NO: 6606 - RNA, 22 nt, Homo Sapiens
ugcugguccuugacucccuggg

SEQ ID NO: 6607 - RNA, 23 nt, Homo Sapiens
ugcuggccccagggcaccugggc

SEQ ID NO: 6608 - RNA, 21 nt, Homo Sapiens
ugcuggucccaugugggccac

SEQ ID NO: 6609 - RNA, 24 nt, Homo Sapiens
uggucugccagcgcccugggcuac

SEQ ID NO: 6610 - RNA, 19 nt, Homo Sapiens
ugcucugaguccugggcua

SEQ ID NO: 6611 - RNA, 83 nt, Homo Sapiens
gugggggcgcucaauaacuuggauaccggucggcauggucacaacacccgacagugcucuucgccagaaguuggcggcccuac

SEQ ID NO: 6612 - RNA, 24 nt, Homo Sapiens
uaacuuggauaccggucggcaugg

SEQ ID NO: 6613 - RNA, 22 nt, Homo Sapiens
aauuuggauaccuucagcuugg

SEQ ID NO: 6614 - RNA, 18 nt, Homo Sapiens
accugguacucggcaugg

SEQ ID NO: 6615 - RNA, 19 nt, Homo Sapiens
cucugagcgugaaguuggc

SEQ ID NO: 6616 - RNA, 20 nt, Homo Sapiens
cuuagcuaucuccggucggc

SEQ ID NO: 6617 - RNA, 22 nt, Homo Sapiens
gcucuucgccuccaaguggagg

SEQ ID NO: 6618 - RNA, 21 nt, Homo Sapiens
gcucuucgcccaggggggcgg

SEQ ID NO: 6619 - RNA, 24 nt, Homo Sapiens
gugcucuuccuggcccgacggugg

SEQ ID NO: 6620 - RNA, 23 nt, Homo Sapiens
gugcacucagacaugaaguuggc

SEQ ID NO: 6621 - RNA, 19 nt, Homo Sapiens
gugcucuucgagcuguugg

SEQ ID NO: 6622 - RNA, 20 nt, Homo Sapiens
ugcucuucgcccugcaaguu

SEQ ID NO: 6623 - RNA, 78 nt, Homo Sapiens
gugugaguggcuuugcaggccugguggugggagagccucaggcucccuccuucuucguuccugaccaugcccuugggc

SEQ ID NO: 6624 - RNA, 24 nt, Homo Sapiens
uugcaggccugguggugggagagc

SEQ ID NO: 6625 - RNA, 20 nt, Homo Sapiens
aggcccucggcggugggaga

SEQ ID NO: 6626 - RNA, 21 nt, Homo Sapiens
aggccugguggcaggugggag

SEQ ID NO: 6627 - RNA, 19 nt, Homo Sapiens
aggccugguggacagagag

SEQ ID NO: 6628 - RNA, 20 nt, Homo Sapiens
caggccuggguugggagagc

SEQ ID NO: 6629 - RNA, 26 nt, Homo Sapiens
ccuucgcuuccuugcuuccugaccau

SEQ ID NO: 6630 - RNA, 23 nt, Homo Sapiens
cccuccuuccuucccccuuccug

SEQ ID NO: 6631 - RNA, 20 nt, Homo Sapiens
cccuccuucuuucuguccug

SEQ ID NO: 6632 - RNA, 25 nt, Homo Sapiens
cccuccuucuccuccucucuggcca

SEQ ID NO: 6633 - RNA, 19 nt, Homo Sapiens
cccuccuucucucccuccu

SEQ ID NO: 6634 - RNA, 24 nt, Homo Sapiens
ccuuccuucuuccuccacuggacc

SEQ ID NO: 6635 - RNA, 19 nt, Homo Sapiens
cccuccuuccacucuccug

SEQ ID NO: 6636 - RNA, 17 nt, Homo Sapiens
cccuccuuccucuccug

SEQ ID NO: 6637 - RNA, 16 nt, Homo Sapiens
cccuccuucuucccug

SEQ ID NO: 6638 - RNA, 20 nt, Homo Sapiens
cccaacaucuacguuccuga

SEQ ID NO: 6639 - RNA, 20 nt, Homo Sapiens
cccuccuucugcauuccaga

SEQ ID NO: 6640 - RNA, 19 nt, Homo Sapiens
cccuccuucccuuccucac

SEQ ID NO: 6641 - RNA, 22 nt, Homo Sapiens
cccuccuucugggacccugucc

SEQ ID NO: 6642 - RNA, 21 nt, Homo Sapiens
cccuccuucuuuguccagccc

SEQ ID NO: 6643 - RNA, 22 nt, Homo Sapiens
cccuccuucuucccucaugcca

SEQ ID NO: 6644 - RNA, 20 nt, Homo Sapiens
ccuuccuucuuccucugcca

SEQ ID NO: 6645 - RNA, 19 nt, Homo Sapiens
ccuccuucuucuucuuccu

SEQ ID NO: 6646 - RNA, 23 nt, Homo Sapiens
ccucuugcucccucuccugacca

SEQ ID NO: 6647 - RNA, 20 nt, Homo Sapiens
ccucuccuuccuuccugacc

SEQ ID NO: 6648 - RNA, 21 nt, Homo Sapiens
ccuccuucuuggcuucucacc

SEQ ID NO: 6649 - RNA, 23 nt, Homo Sapiens
ccuccugccaccucccugaccau

SEQ ID NO: 6650 - RNA, 22 nt, Homo Sapiens
cuccuucuucaucugucaugac

SEQ ID NO: 6651 - RNA, 21 nt, Homo Sapiens
gcagugccugguggcagggag

SEQ ID NO: 6652 - RNA, 21 nt, Homo Sapiens
gcagugguuggugguggggga

SEQ ID NO: 6653 - RNA, 20 nt, Homo Sapiens
gcaggaagccugguggaggg

SEQ ID NO: 6654 - RNA, 26 nt, Homo Sapiens
gcaggcgcguggugguggugaagagc

SEQ ID NO: 6655 - RNA, 19 nt, Homo Sapiens
gcaggccuggaggagggag

SEQ ID NO: 6656 - RNA, 20 nt, Homo Sapiens
gcaggcgcgauggugggaga

SEQ ID NO: 6657 - RNA, 19 nt, Homo Sapiens
gcagggcugggugggagag

SEQ ID NO: 6658 - RNA, 21 nt, Homo Sapiens
gcugcccuuagggugggagag

SEQ ID NO: 6659 - RNA, 22 nt, Homo Sapiens
ggucggguaggggugggagagc

SEQ ID NO: 6660 - RNA, 19 nt, Homo Sapiens
ggccugguggggccacagc

SEQ ID NO: 6661 - RNA, 26 nt, Homo Sapiens
ugcagggccuggugggaauggggaga

SEQ ID NO: 6662 - RNA, 20 nt, Homo Sapiens
ugcagaccccguggugggag

SEQ ID NO: 6663 - RNA, 16 nt, Homo Sapiens
ugcaggccugugggag

SEQ ID NO: 6664 - RNA, 21 nt, Homo Sapiens
ugcagccgagagggugggaga

SEQ ID NO: 6665 - RNA, 22 nt, Homo Sapiens
ugcaggccugggcucggagggc

SEQ ID NO: 6666 - RNA, 19 nt, Homo Sapiens
ugcgggggugguggggagc

SEQ ID NO: 6667 - RNA, 20 nt, Homo Sapiens
uugcaggccaugguguuggg

SEQ ID NO: 6668 - RNA, 25 nt, Homo Sapiens
uugcaggccucgagugguccgugag

SEQ ID NO: 6669 - RNA, 25 nt, Homo Sapiens
uuucaggccuggaggugagaugagc

SEQ ID NO: 6670 - RNA, 20 nt, Homo Sapiens
uugaaagcugguggugggag

SEQ ID NO: 6671 - RNA, 18 nt, Homo Sapiens
uugcccuggugguagaag

SEQ ID NO: 6672 - RNA, 22 nt, Homo Sapiens
uuggaggccugguuuggggagc

SEQ ID NO: 6673 - RNA, 85 nt, Homo Sapiens
gugugcgcugccucuggcauccuagagacccggauuuacucagcuaggagagaggauggaucacagggucuaaggguggccauuc

SEQ ID NO: 6674 - RNA, 24 nt, Homo Sapiens
uggcauccuagagacccggauuua

SEQ ID NO: 6675 - RNA, 20 nt, Homo Sapiens
cagccuagagaccucccgga

SEQ ID NO: 6676 - RNA, 20 nt, Homo Sapiens
ggaauccuagagccaaggau

SEQ ID NO: 6677 - RNA, 17 nt, Homo Sapiens
ugggauccuagagccgg

SEQ ID NO: 6678 - RNA, 22 nt, Homo Sapiens
uggcauccuaggcacucgaauu

SEQ ID NO: 6679 - RNA, 72 nt, Homo Sapiens
guuguggggcugguugcugucuuuacguuucacaaccauggaaggacugccaaccucuacucccuucacagc

SEQ ID NO: 6680 - RNA, 24 nt, Homo Sapiens
gaaggacugccaaccucuacuccc

SEQ ID NO: 6681 - RNA, 19 nt, Homo Sapiens
aaggacugcagaaacuuua

SEQ ID NO: 6682 - RNA, 18 nt, Homo Sapiens
aaggcaugcaccucuacu

SEQ ID NO: 6683 - RNA, 19 nt, Homo Sapiens
acugcaaccucuaacuccc

SEQ ID NO: 6684 - RNA, 19 nt, Homo Sapiens
acugcaaccucuaccuccc

SEQ ID NO: 6685 - RNA, 20 nt, Homo Sapiens
aggacugccacaccuucucc

SEQ ID NO: 6686 - RNA, 18 nt, Homo Sapiens
aggacugccacucacucc

SEQ ID NO: 6687 - RNA, 21 nt, Homo Sapiens
aggacugccgccgucugcgcc

SEQ ID NO: 6688 - RNA, 19 nt, Homo Sapiens
cugccaaccuuccacugcc

SEQ ID NO: 6689 - RNA, 19 nt, Homo Sapiens
cuucccaccuucuacuccc

SEQ ID NO: 6690 - RNA, 20 nt, Homo Sapiens
cuuccaaccucuuuaacucc

SEQ ID NO: 6691 - RNA, 23 nt, Homo Sapiens
gaagacagccauguccucuacuc

SEQ ID NO: 6692 - RNA, 20 nt, Homo Sapiens
ggacugccagccucuucucc

SEQ ID NO: 6693 - RNA, 82 nt, Homo Sapiens
guuguucucagauaucaguucuucccaggugaacagcagugaaucugugacuucaccaaauggauuaaagucaaugagccac

SEQ ID NO: 6694 - RNA, 24 nt, Homo Sapiens
uaucaguucuucccaggugaacag

SEQ ID NO: 6695 - RNA, 21 nt, Homo Sapiens
aguucuuccaaggcuacacag

SEQ ID NO: 6696 - RNA, 20 nt, Homo Sapiens
aguucuucccuauuuaacag

SEQ ID NO: 6697 - RNA, 20 nt, Homo Sapiens
aucauuugcaucccagguga

SEQ ID NO: 6698 - RNA, 23 nt, Homo Sapiens
augaguucuuagccaggugaaca

SEQ ID NO: 6699 - RNA, 20 nt, Homo Sapiens
aucaaaucauuccaggugaa

SEQ ID NO: 6700 - RNA, 22 nt, Homo Sapiens
aucaguaaacccaggugagcag

SEQ ID NO: 6701 - RNA, 20 nt, Homo Sapiens
caguucuuccccuccaggug

SEQ ID NO: 6702 - RNA, 19 nt, Homo Sapiens
caguucuucaccuugugaa

SEQ ID NO: 6703 - RNA, 20 nt, Homo Sapiens
caguucuucacaguucagca

SEQ ID NO: 6704 - RNA, 20 nt, Homo Sapiens
caguugucuucaggugaaca

SEQ ID NO: 6705 - RNA, 19 nt, Homo Sapiens
cuucccaggugcaaaacag

SEQ ID NO: 6706 - RNA, 23 nt, Homo Sapiens
ucagcuucuuccucaggugaaca

SEQ ID NO: 6707 - RNA, 22 nt, Homo Sapiens
ucagcugauugccaggugaaca

SEQ ID NO: 6708 - RNA, 19 nt, Homo Sapiens
ucaguucuucucaagggug

SEQ ID NO: 6709 - RNA, 18 nt, Homo Sapiens
ucauucuucccagaucaa

SEQ ID NO: 6710 - RNA, 19 nt, Homo Sapiens
ucauuugcucccaggugaa

SEQ ID NO: 6711 - RNA, 18 nt, Homo Sapiens
ucuguuuuccaggugaac

SEQ ID NO: 6712 - RNA, 20 nt, Homo Sapiens
ucuguucuucccaugagcag

SEQ ID NO: 6713 - RNA, 19 nt, Homo Sapiens
ucuuccaguaggugaacag

SEQ ID NO: 6714 - RNA, 20 nt, Homo Sapiens
ucuucccagagugugaauag

SEQ ID NO: 6715 - RNA, 20 nt, Homo Sapiens
ucuucccaggcucagaacag

SEQ ID NO: 6716 - RNA, 77 nt, Homo Sapiens
guuucauuccaaugagaguugcacacugucagcuugguuuuguggcugcugauagucguacuuucuugaaauggaau

SEQ ID NO: 6717 - RNA, 24 nt, Homo Sapiens
ugagaguugcacacugucagcuug

SEQ ID NO: 6718 - RNA, 19 nt, Homo Sapiens
agagucugcacacuggcag

SEQ ID NO: 6719 - RNA, 21 nt, Homo Sapiens
agaguugcaacaauucaucuu

SEQ ID NO: 6720 - RNA, 23 nt, Homo Sapiens
agaguccaucacugucagucuug

SEQ ID NO: 6721 - RNA, 21 nt, Homo Sapiens
agagaucacagggucagcuug

SEQ ID NO: 6722 - RNA, 23 nt, Homo Sapiens
gagcagaugcccaacacugucag

SEQ ID NO: 6723 - RNA, 24 nt, Homo Sapiens
gagaguggcuccuggcugucagcu

SEQ ID NO: 6724 - RNA, 21 nt, Homo Sapiens
gagaguugcucccugcagauu

SEQ ID NO: 6725 - RNA, 17 nt, Homo Sapiens
gaguuggccugucagcu

SEQ ID NO: 6726 - RNA, 19 nt, Homo Sapiens
gaguugcacacaggcgcuu

SEQ ID NO: 6727 - RNA, 23 nt, Homo Sapiens
ugaguuguugcacacggacagcu

SEQ ID NO: 6728 - RNA, 20 nt, Homo Sapiens
ugaguguugcccacugucag

SEQ ID NO: 6729 - RNA, 66 nt, Homo Sapiens
uaagauuuuagcaauacuuccaauauugauuuccuuaccaaauggaaucuagaagcuaaauuuuua

SEQ ID NO: 6730 - RNA, 24 nt, Homo Sapiens
uggaaucuagaagcuaaauuuuua

SEQ ID NO: 6731 - RNA, 21 nt, Homo Sapiens
aagcuuuccgucaauacuucc

SEQ ID NO: 6732 - RNA, 20 nt, Homo Sapiens
aaguuugaaugaauacuucc

SEQ ID NO: 6733 - RNA, 24 nt, Homo Sapiens
aaucuagaaacaaugcuaacuuuu

SEQ ID NO: 6734 - RNA, 21 nt, Homo Sapiens
aaucugacugcuaaauuucua

SEQ ID NO: 6735 - RNA, 25 nt, Homo Sapiens
aaucuagaaacuugaauucaauuua

SEQ ID NO: 6736 - RNA, 19 nt, Homo Sapiens
aaucuagaaaauaaauauu

SEQ ID NO: 6737 - RNA, 18 nt, Homo Sapiens
aaugugaaguaaauuuuu

SEQ ID NO: 6738 - RNA, 20 nt, Homo Sapiens
aaaccagaauuaaauuuuua

SEQ ID NO: 6739 - RNA, 21 nt, Homo Sapiens
aguuuguaccugauacuucca

SEQ ID NO: 6740 - RNA, 22 nt, Homo Sapiens
aucuagaagcuugaaaagucuu

SEQ ID NO: 6741 - RNA, 19 nt, Homo Sapiens
auuuggaagcuaaauauuu

SEQ ID NO: 6742 - RNA, 20 nt, Homo Sapiens
auuucauccccacuuccaau

SEQ ID NO: 6743 - RNA, 22 nt, Homo Sapiens
gaaacacaagcuaaauauuuua

SEQ ID NO: 6744 - RNA, 19 nt, Homo Sapiens
gaacauggaagcuaaauuu

SEQ ID NO: 6745 - RNA, 19 nt, Homo Sapiens
gaguuuagcaaucauuucc

SEQ ID NO: 6746 - RNA, 23 nt, Homo Sapiens
ggaaauucuagaagcaaaaauuu

SEQ ID NO: 6747 - RNA, 25 nt, Homo Sapiens
gggaucuauacgcugaaaauuuuua

SEQ ID NO: 6748 - RNA, 23 nt, Homo Sapiens
ggaagcugggggcuaaauuugua

SEQ ID NO: 6749 - RNA, 20 nt, Homo Sapiens
ggaaucaaguaaaauuuuua

SEQ ID NO: 6750 - RNA, 21 nt, Homo Sapiens
uacgaugucaguacuuccaau

SEQ ID NO: 6751 - RNA, 20 nt, Homo Sapiens
ugaauuguauaagcuaaauu

SEQ ID NO: 6752 - RNA, 71 nt, Homo Sapiens
uagagaugggguuucaacuuguuggccaggcuggucuugaacuccuggccccaggugauccacccacuuua

SEQ ID NO: 6753 - RNA, 24 nt, Homo Sapiens
ugggguuucaacuuguuggccagg

SEQ ID NO: 6754 - RNA, 22 nt, Homo Sapiens
ggauuucaaccuccuuguuggc

SEQ ID NO: 6755 - RNA, 18 nt, Homo Sapiens
ggguuucaacuguagcca

SEQ ID NO: 6756 - RNA, 20 nt, Homo Sapiens
gguuuucaacuugcuaguca

SEQ ID NO: 6757 - RNA, 24 nt, Homo Sapiens
ugggguuucacuacguuggccagg

SEQ ID NO: 6758 - RNA, 17 nt, Homo Sapiens
ugagguucuuguuggcc

SEQ ID NO: 6759 - RNA, 77 nt, Homo Sapiens
uagccgugauguccgggggccguguacaucauguuaccgugggguggggucugcauuggcugcugggcauauggcug

SEQ ID NO: 6760 - RNA, 24 nt, Homo Sapiens
uguccgggggccguguacaucaug

SEQ ID NO: 6761 - RNA, 22 nt, Homo Sapiens
ccgggccgggccguguccgauc

SEQ ID NO: 6762 - RNA, 18 nt, Homo Sapiens
cgggggccgcuugucauc

SEQ ID NO: 6763 - RNA, 18 nt, Homo Sapiens
cgggggccgggucauuau

SEQ ID NO: 6764 - RNA, 20 nt, Homo Sapiens
uguccggggggcuuugcaca

SEQ ID NO: 6765 - RNA, 22 nt, Homo Sapiens
uggccgggggcccuguccacca

SEQ ID NO: 6766 - RNA, 100 nt, Homo Sapiens
uagggaaagcugguacgccugcagguaccgguccggaauucccgggucgacccacgcguccgguccgugugcugugccagggccugaaggacucccccug

SEQ ID NO: 6767 - RNA, 24 nt, Homo Sapiens
cugcagguaccgguccggaauucc

SEQ ID NO: 6768 - RNA, 19 nt, Homo Sapiens
agguaccgggcuggucuuc

SEQ ID NO: 6769 - RNA, 19 nt, Homo Sapiens
cugcaugcguccgguccgg

SEQ ID NO: 6770 - RNA, 25 nt, Homo Sapiens
cugcuggccgccgcugcggaauucc

SEQ ID NO: 6771 - RNA, 25 nt, Homo Sapiens
cugcagggaaaggcagccggaauuc

SEQ ID NO: 6772 - RNA, 20 nt, Homo Sapiens
cugcagguaaggggccugga

SEQ ID NO: 6773 - RNA, 21 nt, Homo Sapiens
cugcagguaaccaucagagaa

SEQ ID NO: 6774 - RNA, 17 nt, Homo Sapiens
cugcgucccgguccgga

SEQ ID NO: 6775 - RNA, 20 nt, Homo Sapiens
cuccagcggcggguccggaa

SEQ ID NO: 6776 - RNA, 17 nt, Homo Sapiens
cugcagguagcacggaa

SEQ ID NO: 6777 - RNA, 20 nt, Homo Sapiens
cugcucggccagguccggaa

SEQ ID NO: 6778 - RNA, 21 nt, Homo Sapiens
cugcggaaggaucggaauucc

SEQ ID NO: 6779 - RNA, 22 nt, Homo Sapiens
cugcagcuaggaucggaauucc

SEQ ID NO: 6780 - RNA, 19 nt, Homo Sapiens
gcagcugccgcgguccgga

SEQ ID NO: 6781 - RNA, 20 nt, Homo Sapiens
gcagguaccugcacuggaau

SEQ ID NO: 6782 - RNA, 21 nt, Homo Sapiens
gcagguaccaggggcgguucc

SEQ ID NO: 6783 - RNA, 21 nt, Homo Sapiens
gcugggcccgguccgggaauu

SEQ ID NO: 6784 - RNA, 17 nt, Homo Sapiens
gcagguaccacaggaau

SEQ ID NO: 6785 - RNA, 22 nt, Homo Sapiens
ugcagguacgcgggccugggaa

SEQ ID NO: 6786 - RNA, 22 nt, Homo Sapiens
ugcagucccccugccggaauuc

SEQ ID NO: 6787 - RNA, 19 nt, Homo Sapiens
ugcggcacagccggaauuc

SEQ ID NO: 6788 - RNA, 73 nt, Homo Sapiens
uagggcgccuggcaguggucaagccugaaaccaagcaauacccgucuguuuucacccaagccccagagcccua

SEQ ID NO: 6789 - RNA, 24 nt, Homo Sapiens
uggcaguggucaagccugaaacca

SEQ ID NO: 6790 - RNA, 20 nt, Homo Sapiens
aguggucaaggcagagaaca

SEQ ID NO: 6791 - RNA, 22 nt, Homo Sapiens
cagugggugaagccugaaccca

SEQ ID NO: 6792 - RNA, 20 nt, Homo Sapiens
gcgguggcucaagccuguaa

SEQ ID NO: 6793 - RNA, 22 nt, Homo Sapiens
gcaaugacaaagccugaaaaca

SEQ ID NO: 6794 - RNA, 18 nt, Homo Sapiens
gcagggguccugaaacca

SEQ ID NO: 6795 - RNA, 19 nt, Homo Sapiens
gcaguggucacagaaccca

SEQ ID NO: 6796 - RNA, 21 nt, Homo Sapiens
ggcagugguucaugcuuguaa

SEQ ID NO: 6797 - RNA, 18 nt, Homo Sapiens
ggcgugcugaagccugaa

SEQ ID NO: 6798 - RNA, 17 nt, Homo Sapiens
ggccuuggagccugaaa

SEQ ID NO: 6799 - RNA, 22 nt, Homo Sapiens
ugucaguagguugagccugaaa

SEQ ID NO: 6800 - RNA, 20 nt, Homo Sapiens
ugggacugggcucaagccug

SEQ ID NO: 6801 - RNA, 19 nt, Homo Sapiens
ugacaguggucacauccug

SEQ ID NO: 6802 - RNA, 21 nt, Homo Sapiens
ugacaguggucauguacugaa

SEQ ID NO: 6803 - RNA, 20 nt, Homo Sapiens
uggcaguggucuaccaggaa

SEQ ID NO: 6804 - RNA, 18 nt, Homo Sapiens
uggcagagaagccugaaa

SEQ ID NO: 6805 - RNA, 21 nt, Homo Sapiens
uggcaguggcaagucaaaacc

SEQ ID NO: 6806 - RNA, 75 nt, Homo Sapiens
uaggggucuguaccgggcuggccugugccuaucaccucuuaugcaaaccuucccaccccuguauucccaccccug

SEQ ID NO: 6807 - RNA, 24 nt, Homo Sapiens
ugcaaaccuucccaccccuguauu

SEQ ID NO: 6808 - RNA, 23 nt, Homo Sapiens
aaacucuucccaccacgagugua

SEQ ID NO: 6809 - RNA, 20 nt, Homo Sapiens
aaagcuucccaccuuucuau

SEQ ID NO: 6810 - RNA, 19 nt, Homo Sapiens
caaacauuccccaccccug

SEQ ID NO: 6811 - RNA, 23 nt, Homo Sapiens
caaaccuucaaaccuucucuauu

SEQ ID NO: 6812 - RNA, 16 nt, Homo Sapiens
caaaucccaccccagu

SEQ ID NO: 6813 - RNA, 19 nt, Homo Sapiens
ccuucccacagucuguuuu

SEQ ID NO: 6814 - RNA, 19 nt, Homo Sapiens
gcaacagcucccaccccug

SEQ ID NO: 6815 - RNA, 20 nt, Homo Sapiens
gcaagaccucccaccccagu

SEQ ID NO: 6816 - RNA, 25 nt, Homo Sapiens
ugaaaacauggaccaucccuguauu

SEQ ID NO: 6817 - RNA, 60 nt, Homo Sapiens
uaguauaugaauaugcgggauauaagucuuaugaauagacaccacguauaacucuuacug

SEQ ID NO: 6818 - RNA, 24 nt, Homo Sapiens
uaugaauaugcgggauauaagucu

SEQ ID NO: 6819 - RNA, 24 nt, Homo Sapiens
augaauaugcagccuccauaaucu

SEQ ID NO: 6820 - RNA, 18 nt, Homo Sapiens
auguaaagagggauauaa

SEQ ID NO: 6821 - RNA, 23 nt, Homo Sapiens
augaauaugccugguagaagacu

SEQ ID NO: 6822 - RNA, 18 nt, Homo Sapiens
augcgggauccauagucu

SEQ ID NO: 6823 - RNA, 18 nt, Homo Sapiens
uauaaaaaugggauauaa

SEQ ID NO: 6824 - RNA, 19 nt, Homo Sapiens
ugaauaugcaguuugauau

SEQ ID NO: 6825 - RNA, 22 nt, Homo Sapiens
ugaaucugcccucauauaaguc

SEQ ID NO: 6826 - RNA, 62 nt, Homo Sapiens
uauaagaauaugcugccaauuucugucauugucuuugaccuaucuguuuguguauccuaaua

SEQ ID NO: 6827 - RNA, 24 nt, Homo Sapiens
uaagaauaugcugccaauuucugu

SEQ ID NO: 6828 - RNA, 20 nt, Homo Sapiens
aagauuacugcugccaacuu

SEQ ID NO: 6829 - RNA, 21 nt, Homo Sapiens
aagaauaugcgcaauguuucu

SEQ ID NO: 6830 - RNA, 24 nt, Homo Sapiens
aagcagaugcugccaugcuucugu

SEQ ID NO: 6831 - RNA, 18 nt, Homo Sapiens
aagaauauguccauuuuc

SEQ ID NO: 6832 - RNA, 20 nt, Homo Sapiens
aagaauaugcugcaauuucu

SEQ ID NO: 6833 - RNA, 20 nt, Homo Sapiens
aagccuauguaccaauuucu

SEQ ID NO: 6834 - RNA, 22 nt, Homo Sapiens
aagacaugggcccaauuucugu

SEQ ID NO: 6835 - RNA, 22 nt, Homo Sapiens
aagcauuuucuccaauuucugu

SEQ ID NO: 6836 - RNA, 19 nt, Homo Sapiens
aauagggcugccaauugcu

SEQ ID NO: 6837 - RNA, 20 nt, Homo Sapiens
agaaaguccugccaauuccu

SEQ ID NO: 6838 - RNA, 19 nt, Homo Sapiens
aggauugugucaauuucug

SEQ ID NO: 6839 - RNA, 21 nt, Homo Sapiens
agaaaauuaugcaauuucugu

SEQ ID NO: 6840 - RNA, 19 nt, Homo Sapiens
auagugcuuucaauuucug

SEQ ID NO: 6841 - RNA, 20 nt, Homo Sapiens
auaugcugcuuuauuucugu

SEQ ID NO: 6842 - RNA, 20 nt, Homo Sapiens
gaaugaggugcaauuucugu

SEQ ID NO: 6843 - RNA, 22 nt, Homo Sapiens
uaaggucaauacugccaauuuc

SEQ ID NO: 6844 - RNA, 22 nt, Homo Sapiens
uaaggaaaaugcucugccaauu

SEQ ID NO: 6845 - RNA, 19 nt, Homo Sapiens
uaggauaucugcugccaau

SEQ ID NO: 6846 - RNA, 19 nt, Homo Sapiens
uaagaauauuucugacaau

SEQ ID NO: 6847 - RNA, 24 nt, Homo Sapiens
uaaaacauucuguuccaauuucug

SEQ ID NO: 6848 - RNA, 24 nt, Homo Sapiens
uaagaauauugcacacaauucugu

SEQ ID NO: 6849 - RNA, 23 nt, Homo Sapiens
uaggaauaugcuggcuugaauuu

SEQ ID NO: 6850 - RNA, 21 nt, Homo Sapiens
uaaaauaugcuguaacauuuc

SEQ ID NO: 6851 - RNA, 19 nt, Homo Sapiens
uaagaaaauacugccaauu

SEQ ID NO: 6852 - RNA, 18 nt, Homo Sapiens
uaaaauugaugccaauuu

SEQ ID NO: 6853 - RNA, 21 nt, Homo Sapiens
uaagaauauuuaaaaauuucu

SEQ ID NO: 6854 - RNA, 21 nt, Homo Sapiens
uaagaauauggugucauucug

SEQ ID NO: 6855 - RNA, 21 nt, Homo Sapiens
uaagaauaugaucauuucugu

SEQ ID NO: 6856 - RNA, 61 nt, Homo Sapiens
uauaagauguauaagaagucuuaacgguugcaggguaaccgaugaaauuuuacaucuagua

SEQ ID NO: 6857 - RNA, 24 nt, Homo Sapiens
uaagauguauaagaagucuuaacg

SEQ ID NO: 6858 - RNA, 21 nt, Homo Sapiens
aagauguauccuaagaaaucu

SEQ ID NO: 6859 - RNA, 21 nt, Homo Sapiens
aaguguugagguaagucuuaa

SEQ ID NO: 6860 - RNA, 18 nt, Homo Sapiens
aaaaugcagagaagucuu

SEQ ID NO: 6861 - RNA, 16 nt, Homo Sapiens
aagauuaagaagucuu

SEQ ID NO: 6862 - RNA, 21 nt, Homo Sapiens
aauaugaaccugaagucuuaa

SEQ ID NO: 6863 - RNA, 19 nt, Homo Sapiens
agauggucucgaagucuua

SEQ ID NO: 6864 - RNA, 20 nt, Homo Sapiens
agaguaugaaaagaagucuu

SEQ ID NO: 6865 - RNA, 25 nt, Homo Sapiens
uaagcuuauguauaagacauuuuaa

SEQ ID NO: 6866 - RNA, 23 nt, Homo Sapiens
uaagguuuuauagcaagucuuaa

SEQ ID NO: 6867 - RNA, 21 nt, Homo Sapiens
uaagauggguagagaagucuu

SEQ ID NO: 6868 - RNA, 21 nt, Homo Sapiens
uaagauguagaauucuauaac

SEQ ID NO: 6869 - RNA, 86 nt, Homo Sapiens
uauacagguagagauguaugcagauguguccauauauguuccauauuuacauuuugauagcauggauguaugcaucucuuggugua

SEQ ID NO: 6870 - RNA, 24 nt, Homo Sapiens
auagcauggauguaugcaucucuu

SEQ ID NO: 6871 - RNA, 20 nt, Homo Sapiens
agagauguaagugcuagaug

SEQ ID NO: 6872 - RNA, 29 nt, Homo Sapiens
agagauguauuuggaguuguuguugccau

SEQ ID NO: 6873 - RNA, 20 nt, Homo Sapiens
agaauguaugcagcaugguc

SEQ ID NO: 6874 - RNA, 19 nt, Homo Sapiens
agagcaggagcagaugugu

SEQ ID NO: 6875 - RNA, 17 nt, Homo Sapiens
agaugugcagauguucc

SEQ ID NO: 6876 - RNA, 19 nt, Homo Sapiens
agcugcgugagaugugucc

SEQ ID NO: 6877 - RNA, 20 nt, Homo Sapiens
agauguauggaaauuuccau

SEQ ID NO: 6878 - RNA, 19 nt, Homo Sapiens
agcauggauuuacaugcau

SEQ ID NO: 6879 - RNA, 24 nt, Homo Sapiens
auagcauggauucuuucuaugcau

SEQ ID NO: 6880 - RNA, 28 nt, Homo Sapiens
auagcauggguguuucaaccaucugcuu

SEQ ID NO: 6881 - RNA, 19 nt, Homo Sapiens
auaguaguuguaugcaucu

SEQ ID NO: 6882 - RNA, 24 nt, Homo Sapiens
aucgcauggauggggacaucuguu

SEQ ID NO: 6883 - RNA, 20 nt, Homo Sapiens
auguaugcaagugugugcau

SEQ ID NO: 6884 - RNA, 19 nt, Homo Sapiens
gagauguauggauaaaugu

SEQ ID NO: 6885 - RNA, 16 nt, Homo Sapiens
gaugucagaugugucc

SEQ ID NO: 6886 - RNA, 19 nt, Homo Sapiens
uggauguauguucauucuu

SEQ ID NO: 6887 - RNA, 69 nt, Homo Sapiens
uauagaauuaucuaaauguuucuugagggagaaaaagccagccgaucaagacauucggauaauuuuuua

SEQ ID NO: 6888 - RNA, 24 nt, Homo Sapiens
uagaauuaucuaaauguuucuuga

SEQ ID NO: 6889 - RNA, 20 nt, Homo Sapiens
aauuaucuacaaugucuuuu

SEQ ID NO: 6890 - RNA, 19 nt, Homo Sapiens
aauuaucuaaaugucacuu

SEQ ID NO: 6891 - RNA, 19 nt, Homo Sapiens
aaauacucaauguuucuug

SEQ ID NO: 6892 - RNA, 17 nt, Homo Sapiens
aauucccuuguuucuug

SEQ ID NO: 6893 - RNA, 27 nt, Homo Sapiens
agaauuccuaagacuaauguuucuuga

SEQ ID NO: 6894 - RNA, 18 nt, Homo Sapiens
auuucuaaaugucuuucu

SEQ ID NO: 6895 - RNA, 19 nt, Homo Sapiens
cuaaacuucuguuucuuga

SEQ ID NO: 6896 - RNA, 24 nt, Homo Sapiens
gaauuuaucucccugauguuucuu

SEQ ID NO: 6897 - RNA, 21 nt, Homo Sapiens
gaauaaucuaaaugcuuuguu

SEQ ID NO: 6898 - RNA, 16 nt, Homo Sapiens
gaauuauaauguuucu

SEQ ID NO: 6899 - RNA, 20 nt, Homo Sapiens
gaauuaucucauuuauucuu

SEQ ID NO: 6900 - RNA, 19 nt, Homo Sapiens
uagaaccauuuaaauguuu

SEQ ID NO: 6901 - RNA, 20 nt, Homo Sapiens
uagaauuauagaaaaguuuc

SEQ ID NO: 6902 - RNA, 20 nt, Homo Sapiens
uauaaaaauauaaauguuuc

SEQ ID NO: 6903 - RNA, 74 nt, Homo Sapiens
uaugaaaggugugaacuugcaauguccuccugucuuaaacccaaguugacagugcccucucaaaacuuuucaua

SEQ ID NO: 6904 - RNA, 24 nt, Homo Sapiens
ugaaaggugugaacuugcaauguc

SEQ ID NO: 6905 - RNA, 23 nt, Homo Sapiens
aaaagucuuggaccuugcaaugu

SEQ ID NO: 6906 - RNA, 22 nt, Homo Sapiens
aaacaugagaguuugcaauguc

SEQ ID NO: 6907 - RNA, 20 nt, Homo Sapiens
aaggugugacgugacugcaa

SEQ ID NO: 6908 - RNA, 18 nt, Homo Sapiens
aaggauggacuugcaaug

SEQ ID NO: 6909 - RNA, 25 nt, Homo Sapiens
gaaagcuaugcaaaauugcaauguc

SEQ ID NO: 6910 - RNA, 24 nt, Homo Sapiens
gaaagagugaaagcuuugcaaugu

SEQ ID NO: 6911 - RNA, 19 nt, Homo Sapiens
ugaaagguggugcaccuug

SEQ ID NO: 6912 - RNA, 21 nt, Homo Sapiens
ugaaaggugucagaccugaaa

SEQ ID NO: 6913 - RNA, 24 nt, Homo Sapiens
ugaaagggagacuaaugcaauguc

SEQ ID NO: 6914 - RNA, 19 nt, Homo Sapiens
ugaaaggugaggauuucaa

SEQ ID NO: 6915 - RNA, 24 nt, Homo Sapiens
ugcagggugugaacuguccaucuc

SEQ ID NO: 6916 - RNA, 62 nt, Homo Sapiens
uaugagaaugauccagaauuaggauccgaagagagaggaacuacuccuggauggacaucaua

SEQ ID NO: 6917 - RNA, 24 nt, Homo Sapiens
ugagaaugauccagaauuaggauc

SEQ ID NO: 6918 - RNA, 22 nt, Homo Sapiens
agaaugaucagauuguagcauc

SEQ ID NO: 6919 - RNA, 22 nt, Homo Sapiens
ugagaaugaugaagacaucagg

SEQ ID NO: 6920 - RNA, 64 nt, Homo Sapiens
uauggccgugggccucaacaagggccacaaagugaccaagaacgugagcaagcccaggcacaug

SEQ ID NO: 6921 - RNA, 24 nt, Homo Sapiens
uggccgugggccucaacaagggcc

SEQ ID NO: 6922 - RNA, 20 nt, Homo Sapiens
ccuugcaccucaacaaaggc

SEQ ID NO: 6923 - RNA, 20 nt, Homo Sapiens
ccaugggccucacaaaugcc

SEQ ID NO: 6924 - RNA, 21 nt, Homo Sapiens
ccuugugccccaacaagggcc

SEQ ID NO: 6925 - RNA, 16 nt, Homo Sapiens
ggccguggggacaagg

SEQ ID NO: 6926 - RNA, 19 nt, Homo Sapiens
ggccgugggaucgcaaggg

SEQ ID NO: 6927 - RNA, 20 nt, Homo Sapiens
ggccgugggcauggcaaggg

SEQ ID NO: 6928 - RNA, 22 nt, Homo Sapiens
ggccgugggccaccaccggggc

SEQ ID NO: 6929 - RNA, 17 nt, Homo Sapiens
uggccgugucaacaagg

SEQ ID NO: 6930 - RNA, 21 nt, Homo Sapiens
uggccgugggaauuauuaagg

SEQ ID NO: 6931 - RNA, 20 nt, Homo Sapiens
ugggcugggccucagcaagg

SEQ ID NO: 6932 - RNA, 24 nt, Homo Sapiens
uggacguggcccucuacaagggcc

SEQ ID NO: 6933 - RNA, 80 nt, Homo Sapiens
uaugggguucaauaagguugcaccuaaaagugcucuuccuuaggaaggauuaucgggggcaucuacucaugaaaaccaug

SEQ ID NO: 6934 - RNA, 24 nt, Homo Sapiens
uaagguugcaccuaaaagugcucu

SEQ ID NO: 6935 - RNA, 20 nt, Homo Sapiens
aagguugcaggguacaaagu

SEQ ID NO: 6936 - RNA, 24 nt, Homo Sapiens
aagguugcacagcuaguaaaugug

SEQ ID NO: 6937 - RNA, 22 nt, Homo Sapiens
aaggugccaucuaaagugcucu

SEQ ID NO: 6938 - RNA, 20 nt, Homo Sapiens
agguuggaugaccuaaaagu

SEQ ID NO: 6939 - RNA, 23 nt, Homo Sapiens
agguugcaccuaugagagaugcu

SEQ ID NO: 6940 - RNA, 21 nt, Homo Sapiens
agguugcacugagcagugauc

SEQ ID NO: 6941 - RNA, 21 nt, Homo Sapiens
aggaggcaccuaaagaacucu

SEQ ID NO: 6942 - RNA, 18 nt, Homo Sapiens
gguugcauuaaagugcuc

SEQ ID NO: 6943 - RNA, 20 nt, Homo Sapiens
guugcaccucagagcugauc

SEQ ID NO: 6944 - RNA, 21 nt, Homo Sapiens
uaaaguuacauccuaaaagug

SEQ ID NO: 6945 - RNA, 21 nt, Homo Sapiens
ugcaaugccuacaaagugcuc

SEQ ID NO: 6946 - RNA, 68 nt, Homo Sapiens
uauucccgcuggcagcaggcaccgcuggcccccuucguucccggcacgcuggcugauggcguggugua

SEQ ID NO: 6947 - RNA, 24 nt, Homo Sapiens
uucccgcuggcagcaggcaccgcu

SEQ ID NO: 6948 - RNA, 21 nt, Homo Sapiens
ccugcaggcagcaggaacugc

SEQ ID NO: 6949 - RNA, 20 nt, Homo Sapiens
ccacuggccagcaggcagcg

SEQ ID NO: 6950 - RNA, 23 nt, Homo Sapiens
ucccggcccagggcaggcaccgc

SEQ ID NO: 6951 - RNA, 23 nt, Homo Sapiens
ucccgucugccgcagcaggcacc

SEQ ID NO: 6952 - RNA, 24 nt, Homo Sapiens
ucccccucagcagcaggccccacu

SEQ ID NO: 6953 - RNA, 20 nt, Homo Sapiens
uuccucccugggcaggcacc

SEQ ID NO: 6954 - RNA, 23 nt, Homo Sapiens
uucccagacuggaggcaggcacc

SEQ ID NO: 6955 - RNA, 21 nt, Homo Sapiens
uugcggcuggauagcaggcac

SEQ ID NO: 6956 - RNA, 19 nt, Homo Sapiens
uuuccgcuggcagacaugc

SEQ ID NO: 6957 - RNA, 86 nt, Homo Sapiens
ucaauggaagcgguacuuucuggcuggcuugagguugauguauguggccuucaucuccucggccucaggguuccgcacaucuuuga

SEQ ID NO: 6958 - RNA, 24 nt, Homo Sapiens
ucuccucggccucaggguuccgca

SEQ ID NO: 6959 - RNA, 21 nt, Homo Sapiens
ccucuggucucaaggguuccg

SEQ ID NO: 6960 - RNA, 20 nt, Homo Sapiens
ccuccgccucagggccuucc

SEQ ID NO: 6961 - RNA, 20 nt, Homo Sapiens
ccuccucuucaggguuccgc

SEQ ID NO: 6962 - RNA, 21 nt, Homo Sapiens
ccucggccuccggguccggca

SEQ ID NO: 6963 - RNA, 21 nt, Homo Sapiens
cuccuucaggccucagguucc

SEQ ID NO: 6964 - RNA, 21 nt, Homo Sapiens
cugcacgguccucaggguccc

SEQ ID NO: 6965 - RNA, 20 nt, Homo Sapiens
cuccuggccucaggugaucc

SEQ ID NO: 6966 - RNA, 22 nt, Homo Sapiens
cuccuggccucaggugaucugc

SEQ ID NO: 6967 - RNA, 23 nt, Homo Sapiens
cuccuaaccucagggugauccgc

SEQ ID NO: 6968 - RNA, 18 nt, Homo Sapiens
cuccugguaucaggguuc

SEQ ID NO: 6969 - RNA, 17 nt, Homo Sapiens
cuccucggccaguguuc

SEQ ID NO: 6970 - RNA, 21 nt, Homo Sapiens
cuccucggccucagcugccgc

SEQ ID NO: 6971 - RNA, 19 nt, Homo Sapiens
cucauccucaggguccaca

SEQ ID NO: 6972 - RNA, 19 nt, Homo Sapiens
uccgcagccucagggcucc

SEQ ID NO: 6973 - RNA, 19 nt, Homo Sapiens
ucguaguccccaggguucc

SEQ ID NO: 6974 - RNA, 20 nt, Homo Sapiens
uccugggccucagggagccg

SEQ ID NO: 6975 - RNA, 18 nt, Homo Sapiens
uccucggccuggauccgc

SEQ ID NO: 6976 - RNA, 19 nt, Homo Sapiens
uccucccgcggguuccgca

SEQ ID NO: 6977 - RNA, 19 nt, Homo Sapiens
ucggccacagaggguuccg

SEQ ID NO: 6978 - RNA, 19 nt, Homo Sapiens
ucggccucagcccucccca

SEQ ID NO: 6979 - RNA, 21 nt, Homo Sapiens
ucuccccuggggccucagggu

SEQ ID NO: 6980 - RNA, 17 nt, Homo Sapiens
ucuccucacucaggguu

SEQ ID NO: 6981 - RNA, 23 nt, Homo Sapiens
uccccucucacucuggguuccgc

SEQ ID NO: 6982 - RNA, 63 nt, Homo Sapiens
ucacagagauaucaaaccuuccaauauucuucuggacagaaguggaaauauuaagcucuguga

SEQ ID NO: 6983 - RNA, 24 nt, Homo Sapiens
uaucaaaccuuccaauauucuucu

SEQ ID NO: 6984 - RNA, 23 nt, Homo Sapiens
aaaccuuccgcuuaucuucuucu

SEQ ID NO: 6985 - RNA, 19 nt, Homo Sapiens
aaaucuuccaauaauuuuc

SEQ ID NO: 6986 - RNA, 18 nt, Homo Sapiens
aauccaucaauauucuuc

SEQ ID NO: 6987 - RNA, 19 nt, Homo Sapiens
accuuuugccaauauucuu

SEQ ID NO: 6988 - RNA, 25 nt, Homo Sapiens
aucaaaccuauuuacaaaauuuuuc

SEQ ID NO: 6989 - RNA, 20 nt, Homo Sapiens
aucaaugcucauuccaauau

SEQ ID NO: 6990 - RNA, 18 nt, Homo Sapiens
aucaaaccucaaaccuuc

SEQ ID NO: 6991 - RNA, 22 nt, Homo Sapiens
aucaucacaucaaauauucuuc

SEQ ID NO: 6992 - RNA, 21 nt, Homo Sapiens
auuaaaauuuuaauauucuuc

SEQ ID NO: 6993 - RNA, 23 nt, Homo Sapiens
aucuaacaauacaauauucuucu

SEQ ID NO: 6994 - RNA, 19 nt, Homo Sapiens
caaaccuucccaacuuucu

SEQ ID NO: 6995 - RNA, 21 nt, Homo Sapiens
caaucaauccaauauucuucu

SEQ ID NO: 6996 - RNA, 26 nt, Homo Sapiens
uauaaagaccccaccauuauucuucu

SEQ ID NO: 6997 - RNA, 20 nt, Homo Sapiens
uauaaauaccuuccaauuuc

SEQ ID NO: 6998 - RNA, 19 nt, Homo Sapiens
uaucaaaccugugcuccaa

SEQ ID NO: 6999 - RNA, 28 nt, Homo Sapiens
uaugcaaccuuccaacuccaauucuucu

SEQ ID NO: 7000 - RNA, 18 nt, Homo Sapiens
uaucaaaccuuuaaaauu

SEQ ID NO: 7001 - RNA, 22 nt, Homo Sapiens
uauaaaccuaaaauauucuucu

SEQ ID NO: 7002 - RNA, 21 nt, Homo Sapiens
uaucaguuccaauaugcuucu

SEQ ID NO: 7003 - RNA, 20 nt, Homo Sapiens
ucaaaccuuccucuucguuc

SEQ ID NO: 7004 - RNA, 19 nt, Homo Sapiens
ucaaaccuucaaaccuucu

SEQ ID NO: 7005 - RNA, 16 nt, Homo Sapiens
ucaaaccuuccuucuu

SEQ ID NO: 7006 - RNA, 18 nt, Homo Sapiens
ucaauucaaauauucuuc

SEQ ID NO: 7007 - RNA, 22 nt, Homo Sapiens
ucacaccuuccaaagugccucu

SEQ ID NO: 7008 - RNA, 92 nt, Homo Sapiens
ucaccaucugcagccuugaaggagcuugguucggagacaggcaaaggagccauguguggagagccugguuucucaguacuuccagaccguga

SEQ ID NO: 7009 - RNA, 24 nt, Homo Sapiens
guguggagagccugguuucucagu

SEQ ID NO: 7010 - RNA, 19 nt, Homo Sapiens
agagccugguuuucucagu

SEQ ID NO: 7011 - RNA, 19 nt, Homo Sapiens
gagagccuguugacucugu

SEQ ID NO: 7012 - RNA, 20 nt, Homo Sapiens
ggagagcaggacugguuucu

SEQ ID NO: 7013 - RNA, 21 nt, Homo Sapiens
ggaaagccugguugauucuca

SEQ ID NO: 7014 - RNA, 22 nt, Homo Sapiens
guggagagccugccuugcucag

SEQ ID NO: 7015 - RNA, 18 nt, Homo Sapiens
guggggagagccuuuuuc

SEQ ID NO: 7016 - RNA, 24 nt, Homo Sapiens
guguggagaccugucuucaacagu

SEQ ID NO: 7017 - RNA, 21 nt, Homo Sapiens
uggagugcacuauuucucagu

SEQ ID NO: 7018 - RNA, 21 nt, Homo Sapiens
ugcagggcuugguuucucugu

SEQ ID NO: 7019 - RNA, 19 nt, Homo Sapiens
uggagaggcuuuucucagu

SEQ ID NO: 7020 - RNA, 24 nt, Homo Sapiens
uguggagagaguuggauuucccag

SEQ ID NO: 7021 - RNA, 23 nt, Homo Sapiens
uguggagagucaggcugucuaag

SEQ ID NO: 7022 - RNA, 18 nt, Homo Sapiens
uguggcgccgguuucuca

SEQ ID NO: 7023 - RNA, 21 nt, Homo Sapiens
ugugagagccugccuugccag

SEQ ID NO: 7024 - RNA, 19 nt, Homo Sapiens
uguggagagggucacucag

SEQ ID NO: 7025 - RNA, 21 nt, Homo Sapiens
uguuuagagccuggguuccag

SEQ ID NO: 7026 - RNA, 22 nt, Homo Sapiens
ugugagagccuguguucccagu

SEQ ID NO: 7027 - RNA, 23 nt, Homo Sapiens
uguggcaaaccagguuucucagu

SEQ ID NO: 7028 - RNA, 93 nt, Homo Sapiens
ucaccaucugcagccuugaaggagcuuugguucggagacaggcaaaggagccauguguggagagccugguuucucaguacuuccagaccguga

SEQ ID NO: 7029 - RNA, 93 nt, Homo Sapiens; identical to SEQ ID NO: 7028

SEQ ID NO: 7030 - RNA, 93 nt, Homo Sapiens; identical to SEQ ID NO: 7028

SEQ ID NO: 7031 - RNA, 93 nt, Homo Sapiens; identical to SEQ ID NO: 7028

SEQ ID NO: 7032 - RNA, 93 nt, Homo Sapiens; identical to SEQ ID NO: 7028

SEQ ID NO: 7033 - RNA, 93 nt, Homo Sapiens; identical to SEQ ID NO: 7028

SEQ ID NO: 7034 - RNA, 93 nt, Homo Sapiens; identical to SEQ ID NO: 7028

SEQ ID NO: 7035 - RNA, 93 nt, Homo Sapiens; identical to SEQ ID NO: 7028

SEQ ID NO: 7036 - RNA, 93 nt, Homo Sapiens; identical to SEQ ID NO: 7028

SEQ ID NO: 7037 - RNA, 93 nt, Homo Sapiens; identical to SEQ ID NO: 7028

SEQ ID NO: 7038 - RNA, 93 nt, Homo Sapiens; identical to SEQ ID NO: 7028

SEQ ID NO: 7039 - RNA, 93 nt, Homo Sapiens; identical to SEQ ID NO: 7028

SEQ ID NO: 7040 - RNA, 93 nt, Homo Sapiens; identical to SEQ ID NO: 7028

SEQ ID NO: 7041 - RNA, 93 nt, Homo Sapiens; identical to SEQ ID NO: 7028

SEQ ID NO: 7042 - RNA, 93 nt, Homo Sapiens; identical to SEQ ID NO: 7028

SEQ ID NO: 7043 - RNA, 93 nt, Homo Sapiens; identical to SEQ ID NO: 7028

SEQ ID NO: 7044 - RNA, 93 nt, Homo Sapiens; identical to SEQ ID NO: 7028

SEQ ID NO: 7045 - RNA, 93 nt, Homo Sapiens; identical to SEQ ID NO: 7028

SEQ ID NO: 7046 - RNA, 93 nt, Homo Sapiens; identical to SEQ ID NO: 7028

SEQ ID NO: 7047 - RNA, 93 nt, Homo Sapiens; identical to SEQ ID NO: 7028

SEQ ID NO: 7048 - RNA, 93 nt, Homo Sapiens; identical to SEQ ID NO: 7028

SEQ ID NO: 7049 - RNA, 93 nt, Homo Sapiens; identical to SEQ ID NO: 7028

SEQ ID NO: 7050 - RNA, 93 nt, Homo Sapiens; identical to SEQ ID NO: 7028

SEQ ID NO: 7051 - RNA, 93 nt, Homo Sapiens; identical to SEQ ID NO: 7028

SEQ ID NO: 7052 - RNA, 93 nt, Homo Sapiens; identical to SEQ ID NO: 7028

SEQ ID NO: 7053 - RNA, 93 nt, Homo Sapiens; identical to SEQ ID NO: 7028

SEQ ID NO: 7054 - RNA, 93 nt, Homo Sapiens; identical to SEQ ID NO: 7028

SEQ ID NO: 7055 - RNA, 93 nt, Homo Sapiens; identical to SEQ ID NO: 7028

SEQ ID NO: 7056 - RNA, 93 nt, Homo Sapiens; identical to SEQ ID NO: 7028

SEQ ID NO: 7057 - RNA, 93 nt, Homo Sapiens; identical to SEQ ID NO: 7028

SEQ ID NO: 7058 - RNA, 93 nt, Homo Sapiens; identical to SEQ ID NO: 7028

SEQ ID NO: 7059 - RNA, 93 nt, Homo Sapiens; identical to SEQ ID NO: 7028

SEQ ID NO: 7060 - RNA, 93 nt, Homo Sapiens; identical to SEQ ID NO: 7028

SEQ ID NO: 7061 - RNA, 64 nt, Homo Sapiens
ucacccugucgcacuucaccguggggauaacggggucuaccauggucuagaagugcacugguga

SEQ ID NO: 7062 - RNA, 24 nt, Homo Sapiens
accauggucuagaagugcacuggu

SEQ ID NO: 7063 - RNA, 20 nt, Homo Sapiens
accaugguccuagagaggca

SEQ ID NO: 7064 - RNA, 22 nt, Homo Sapiens
accaaggcuggagugcacuggu

SEQ ID NO: 7065 - RNA, 20 nt, Homo Sapiens
auggucuagaacauguacug

SEQ ID NO: 7066 - RNA, 22 nt, Homo Sapiens
caugcuuagaaacugcacuggu

SEQ ID NO: 7067 - RNA, 25 nt, Homo Sapiens
ccacugugucaaacugugcacuggu

SEQ ID NO: 7068 - RNA, 24 nt, Homo Sapiens
ccaggaguuugggugugcacuggu

SEQ ID NO: 7069 - RNA, 22 nt, Homo Sapiens
ccaagguucuagaaguugacug

SEQ ID NO: 7070 - RNA, 18 nt, Homo Sapiens
ccaucucuuaagugcacu

SEQ ID NO: 7071 - RNA, 21 nt, Homo Sapiens
ccauggucuaggcucaguggu

SEQ ID NO: 7072 - RNA, 23 nt, Homo Sapiens
ccauggucugguggggcccuggu

SEQ ID NO: 7073 - RNA, 22 nt, Homo Sapiens
ucuagaaguggacgucacuggu

SEQ ID NO: 7074 - RNA, 19 nt, Homo Sapiens
uggcuccaggagugcacug

SEQ ID NO: 7075 - RNA, 100 nt, Homo Sapiens
ucaggaacaugguuaccccacgaucaacuuggguauuguaggagacaacccagaugacuuacucaaugccuugaauugagggguauucagucgugcuuga

SEQ ID NO: 7076 - RNA, 24 nt, Homo Sapiens
ugacuuacucaaugccuugaauug

SEQ ID NO: 7077 - RNA, 20 nt, Homo Sapiens
cuuacuaguuucuugaauug

SEQ ID NO: 7078 - RNA, 19 nt, Homo Sapiens
gacuuacuccuaaaggcuu

SEQ ID NO: 7079 - RNA, 22 nt, Homo Sapiens
uagucaacacugacuugaauug

SEQ ID NO: 7080 - RNA, 23 nt, Homo Sapiens
ugacaaugacucaaugcuuuuaa

SEQ ID NO: 7081 - RNA, 19 nt, Homo Sapiens
ugacuuuacucaaucuuug

SEQ ID NO: 7082 - RNA, 26 nt, Homo Sapiens
ugaauguucucaaugccgagacauug

SEQ ID NO: 7083 - RNA, 19 nt, Homo Sapiens
ugucuucaccaaugccuug

SEQ ID NO: 7084 - RNA, 22 nt, Homo Sapiens
ugacugacuacagcaaugccuu

SEQ ID NO: 7085 - RNA, 19 nt, Homo Sapiens
ugacuuacugagcucccuu

SEQ ID NO: 7086 - RNA, 22 nt, Homo Sapiens
uggcuuuaucaaugccuaugaa

SEQ ID NO: 7087 - RNA, 19 nt, Homo Sapiens
ugaccucacugccuugaau

SEQ ID NO: 7088 - RNA, 21 nt, Homo Sapiens
ugacuuacuugcauuaaacug

SEQ ID NO: 7089 - RNA, 24 nt, Homo Sapiens
uggcuucauggauggcuugaauug

SEQ ID NO: 7090 - RNA, 18 nt, Homo Sapiens
uuaaacaauccuugaauu

SEQ ID NO: 7091 - RNA, 69 nt, Homo Sapiens
ucagugccccagcugcaauggccccaucuuccccccaaccaacuggcuggcccguggccuccgcacuga

SEQ ID NO: 7092 - RNA, 22 nt, Homo Sapiens
uggcccguggccuccgcacuga

SEQ ID NO: 7093 - RNA, 19 nt, Homo Sapiens
cccggcuccuccgcacuga

SEQ ID NO: 7094 - RNA, 20 nt, Homo Sapiens
ggcgccgagcuccgcacuga

SEQ ID NO: 7095 - RNA, 19 nt, Homo Sapiens
ggcccguggcaucgccgca

SEQ ID NO: 7096 - RNA, 20 nt, Homo Sapiens
ugggcggcggccuccgcgcu

SEQ ID NO: 7097 - RNA, 19 nt, Homo Sapiens
uggugcguggccucgcucu

SEQ ID NO: 7098 - RNA, 20 nt, Homo Sapiens
uggaccuguucuccgcacug

SEQ ID NO: 7099 - RNA, 72 nt, Homo Sapiens
ucaguuauucaggaguuucuguauggggcacaaauuagcucuucuuagcagcagacuaaucugaagaaauga

SEQ ID NO: 7100 - RNA, 24 nt, Homo Sapiens
cuuagcagcagacuaaucugaaga

SEQ ID NO: 7101 - RNA, 20 nt, Homo Sapiens
agcagcagaagacuaucuga

SEQ ID NO: 7102 - RNA, 22 nt, Homo Sapiens
agcagcagauauuuauucugaa

SEQ ID NO: 7103 - RNA, 19 nt, Homo Sapiens
agcagcagacagcugcaga

SEQ ID NO: 7104 - RNA, 19 nt, Homo Sapiens
cuuagcagcaaaauuuucu

SEQ ID NO: 7105 - RNA, 21 nt, Homo Sapiens
cuuagcagcagcuucucugaa

SEQ ID NO: 7106 - RNA, 20 nt, Homo Sapiens
cuuaccagagaaucugaaga

SEQ ID NO: 7107 - RNA, 25 nt, Homo Sapiens
uagcaguaagugucaaaucugaaga

SEQ ID NO: 7108 - RNA, 21 nt, Homo Sapiens
uagccagucauuaaucugaag

SEQ ID NO: 7109 - RNA, 21 nt, Homo Sapiens
uagcagcaggaaugcuggaag

SEQ ID NO: 7110 - RNA, 20 nt, Homo Sapiens
uagcagcagcaucugcaaga

SEQ ID NO: 7111 - RNA, 19 nt, Homo Sapiens
uagcagcagcaaaaucaga

SEQ ID NO: 7112 - RNA, 24 nt, Homo Sapiens
uuagccagcaaacaguaaucugaa

SEQ ID NO: 7113 - RNA, 21 nt, Homo Sapiens
uuagcagcaguucagcaaucu

SEQ ID NO: 7114 - RNA, 22 nt, Homo Sapiens
uuagcagcaaaguaguuugaag

SEQ ID NO: 7115 - RNA, 60 nt, Homo Sapiens
ucauaccaguuuccaucaggauuuaucagaucugaaacauccugcagauaagcugguuga

SEQ ID NO: 7116 - RNA, 60 nt, Homo Sapiens; identical to SEQ ID NO: 7115

SEQ ID NO: 7117 - RNA, 60 nt, Homo Sapiens; identical to SEQ ID NO: 7115

SEQ ID NO: 7118 - RNA, 60 nt, Homo Sapiens; identical to SEQ ID NO: 7115

SEQ ID NO: 7119 - RNA, 60 nt, Homo Sapiens; identical to SEQ ID NO: 7115

SEQ ID NO: 7120 - RNA, 60 nt, Homo Sapiens; identical to SEQ ID NO: 7115

SEQ ID NO: 7121 - RNA, 60 nt, Homo Sapiens; identical to SEQ ID NO: 7115

SEQ ID NO: 7122 - RNA, 60 nt, Homo Sapiens; identical to SEQ ID NO: 7115

SEQ ID NO: 7123 - RNA, 60 nt, Homo Sapiens; identical to SEQ ID NO: 7115

SEQ ID NO: 7124 - RNA, 60 nt, Homo Sapiens; identical to SEQ ID NO: 7115

SEQ ID NO: 7125 - RNA, 60 nt, Homo Sapiens; identical to SEQ ID NO: 7115

SEQ ID NO: 7126 - RNA, 60 nt, Homo Sapiens; identical to SEQ ID NO: 7115

SEQ ID NO: 7127 - RNA, 70 nt, Homo Sapiens
ucaucgauggcaaggguguccuucgccagaucacuguuaaugauuugccugugggacgcuccguggauga

SEQ ID NO: 7128 - RNA, 24 nt, Homo Sapiens
uggcaaggguguccuucgccagau

SEQ ID NO: 7129 - RNA, 20 nt, Homo Sapiens
aagcguaccccucgccagau

SEQ ID NO: 7130 - RNA, 20 nt, Homo Sapiens
aggguguccccguuggccag

SEQ ID NO: 7131 - RNA, 16 nt, Homo Sapiens
aggguguccugccgau

SEQ ID NO: 7132 - RNA, 22 nt, Homo Sapiens
cauggguuccacaucgccagau

SEQ ID NO: 7133 - RNA, 21 nt, Homo Sapiens
caaggguguucuccgcaggau

SEQ ID NO: 7134 - RNA, 19 nt, Homo Sapiens
gcaaagguguccuugcaga

SEQ ID NO: 7135 - RNA, 23 nt, Homo Sapiens
ggcaggaaguguccuucagacag

SEQ ID NO: 7136 - RNA, 20 nt, Homo Sapiens
ggcagggggucuccuucgcc

SEQ ID NO: 7137 - RNA, 21 nt, Homo Sapiens
ggccaggguguccacggccag

SEQ ID NO: 7138 - RNA, 19 nt, Homo Sapiens
gguguccuuggcacucaga

SEQ ID NO: 7139 - RNA, 19 nt, Homo Sapiens
guguccuucucccccagau

SEQ ID NO: 7140 - RNA, 23 nt, Homo Sapiens
uggcaagggguuuccagcagcca

SEQ ID NO: 7141 - RNA, 19 nt, Homo Sapiens
uggcaaggguuuauguccu

SEQ ID NO: 7142 - RNA, 17 nt, Homo Sapiens
uggccgggguccuucgc

SEQ ID NO: 7143 - RNA, 20 nt, Homo Sapiens
uggcaaggguauacuccacc

SEQ ID NO: 7144 - RNA, 20 nt, Homo Sapiens
uggcaagggcugcggcgcca

SEQ ID NO: 7145 - RNA, 63 nt, Homo Sapiens
ucauuuuguuuucuuucucuuaauucuguuaauuuauuuaaucucaugggagagaaaacauga

SEQ ID NO: 7146 - RNA, 22 nt, Homo Sapiens
ucucaugggagagaaaacauga

SEQ ID NO: 7147 - RNA, 19 nt, Homo Sapiens
auuggagaaagaaaacaug

SEQ ID NO: 7148 - RNA, 19 nt, Homo Sapiens
cauguuaggagagaaaaca

SEQ ID NO: 7149 - RNA, 21 nt, Homo Sapiens
caugagucagagaaaacauga

SEQ ID NO: 7150 - RNA, 19 nt, Homo Sapiens
cuccuaggagagaaagcau

SEQ ID NO: 7151 - RNA, 18 nt, Homo Sapiens
cucauagggaaaacauga

SEQ ID NO: 7152 - RNA, 20 nt, Homo Sapiens
ucaugggagccaaggaagca

SEQ ID NO: 7153 - RNA, 20 nt, Homo Sapiens
ucauugcagaaaaaacauga

SEQ ID NO: 7154 - RNA, 19 nt, Homo Sapiens
ucuuggcaagaaaacauga

SEQ ID NO: 7155 - RNA, 20 nt, Homo Sapiens
ucuccaugggagaggauaca

SEQ ID NO: 7156 - RNA, 21 nt, Homo Sapiens
ucucaugggagaagaguaaac

SEQ ID NO: 7157 - RNA, 19 nt, Homo Sapiens
ucucaugggaaaugauaac

SEQ ID NO: 7158 - RNA, 19 nt, Homo Sapiens
ucugauggagagaaaacau

SEQ ID NO: 7159 - RNA, 21 nt, Homo Sapiens
ucucauaggagaaaaacauga

SEQ ID NO: 7160 - RNA, 18 nt, Homo Sapiens
ucucaugggaaaaaauga

SEQ ID NO: 7161 - RNA, 20 nt, Homo Sapiens
ucguucgucuuaauucuguu

SEQ ID NO: 7162 - RNA, 23 nt, Homo Sapiens
ugucuuccuuucucuuuacuguu

SEQ ID NO: 7163 - RNA, 23 nt, Homo Sapiens
uguuuucuucuugucuccauucu

SEQ ID NO: 7164 - RNA, 27 nt, Homo Sapiens
uguuuucuuguuuccuacuauucuguu

SEQ ID NO: 7165 - RNA, 24 nt, Homo Sapiens
uguuuucuucuccuuaauacuauu

SEQ ID NO: 7166 - RNA, 24 nt, Homo Sapiens
uguauucuuucucaucuuaaugcu

SEQ ID NO: 7167 - RNA, 29 nt, Homo Sapiens
uguuuccuugcucaguuaucaauucuguu

SEQ ID NO: 7168 - RNA, 25 nt, Homo Sapiens
uguguauuuucucugcuaauucugu

SEQ ID NO: 7169 - RNA, 25 nt, Homo Sapiens
ugaucucuuucucuuccuguguguu

SEQ ID NO: 7170 - RNA, 19 nt, Homo Sapiens
uguuuucuuuugaaauucu

SEQ ID NO: 7171 - RNA, 20 nt, Homo Sapiens
uguuuucuuucuuucuuucu

SEQ ID NO: 7172 - RNA, 22 nt, Homo Sapiens
ugcuuucuuucuuucuuucguu

SEQ ID NO: 7173 - RNA, 19 nt, Homo Sapiens
uucuuucucuugcuccugu

SEQ ID NO: 7174 - RNA, 24 nt, Homo Sapiens
uuucuuucucucagaaaagcuguu

SEQ ID NO: 7175 - RNA, 19 nt, Homo Sapiens
uuucuuucuuucuuuuguu

SEQ ID NO: 7176 - RNA, 19 nt, Homo Sapiens
uugucguuuccuuaauucu

SEQ ID NO: 7177 - RNA, 25 nt, Homo Sapiens
uuuucuuucuuuuuuaauaaucugu

SEQ ID NO: 7178 - RNA, 19 nt, Homo Sapiens
uuuucuuuccuucugaauu

SEQ ID NO: 7179 - RNA, 22 nt, Homo Sapiens
uuuucuuucugcuuaaaugcug

SEQ ID NO: 7180 - RNA, 19 nt, Homo Sapiens
uuuucuaucuucuuaauuc

SEQ ID NO: 7181 - RNA, 26 nt, Homo Sapiens
uuuuguuuuucguuuuuaauucuguu

SEQ ID NO: 7182 - RNA, 23 nt, Homo Sapiens
uuuucuuucuuuuuuaaauucug

SEQ ID NO: 7183 - RNA, 24 nt, Homo Sapiens
uuuuuuuucucuuagcaucucugu

SEQ ID NO: 7184 - RNA, 23 nt, Homo Sapiens
uuuucuuucucuuaguugcuuuu

SEQ ID NO: 7185 - RNA, 18 nt, Homo Sapiens
uuuucuuucuuucuuucu

SEQ ID NO: 7186 - RNA, 18 nt, Homo Sapiens
uuuucuuucucuuauucu

SEQ ID NO: 7187 - RNA, 19 nt, Homo Sapiens
uuuucuuucuuuuuccugu

SEQ ID NO: 7188 - RNA, 22 nt, Homo Sapiens
uuuucuuucccuuuuuuguguu

SEQ ID NO: 7189 - RNA, 20 nt, Homo Sapiens
uuuucuuucuuuauucuuuu

SEQ ID NO: 7190 - RNA, 20 nt, Homo Sapiens
uuuucuuucucuuuccuguu

SEQ ID NO: 7191 - RNA, 68 nt, Homo Sapiens
uccaggguuaguuuuuguagccucgguggcccgucggcucauggacgcucgaacuuccggcccuugga

SEQ ID NO: 7192 - RNA, 24 nt, Homo Sapiens
uggacgcucgaacuuccggcccuu

SEQ ID NO: 7193 - RNA, 19 nt, Homo Sapiens
acgcucgaagaccgccggc

SEQ ID NO: 7194 - RNA, 21 nt, Homo Sapiens
acccuguaacguccggcccuu

SEQ ID NO: 7195 - RNA, 19 nt, Homo Sapiens
cgccggaacuuuccggccc

SEQ ID NO: 7196 - RNA, 18 nt, Homo Sapiens
cgcgcgcucccggcccuu

SEQ ID NO: 7197 - RNA, 20 nt, Homo Sapiens
gacccgcgaccacuuccggc

SEQ ID NO: 7198 - RNA, 20 nt, Homo Sapiens
ggagcugaaacccggcccuu

SEQ ID NO: 7199 - RNA, 23 nt, Homo Sapiens
gggcgcucccgcucccggcccuu

SEQ ID NO: 7200 - RNA, 25 nt, Homo Sapiens
uggaaacacgaacuuccggucucuu

SEQ ID NO: 7201 - RNA, 17 nt, Homo Sapiens
uggacgcucaccucggc

SEQ ID NO: 7202 - RNA, 19 nt, Homo Sapiens
uggcguggaacuuccgccc

SEQ ID NO: 7203 - RNA, 20 nt, Homo Sapiens
uggacgcuccaacccgggcc

SEQ ID NO: 7204 - RNA, 22 nt, Homo Sapiens
uggcggcgcgcgcuuccggccc

SEQ ID NO: 7205 - RNA, 70 nt, Homo Sapiens
ucccccuaccccacuuuugccuucuaacuuuggugcccagcucagggugaggcaguuaaggguccaggga

SEQ ID NO: 7206 - RNA, 24 nt, Homo Sapiens
ucagggugaggcaguuaagggucc

SEQ ID NO: 7207 - RNA, 23 nt, Homo Sapiens
aggguaaagagaaaguuaagggu

SEQ ID NO: 7208 - RNA, 19 nt, Homo Sapiens
agggugagggcagugcagg

SEQ ID NO: 7209 - RNA, 19 nt, Homo Sapiens
agggagagcacaguuaagg

SEQ ID NO: 7210 - RNA, 19 nt, Homo Sapiens
aggguggcacuuaaggguc

SEQ ID NO: 7211 - RNA, 21 nt, Homo Sapiens
caggcuggaugcaguuaaggg

SEQ ID NO: 7212 - RNA, 19 nt, Homo Sapiens
cagggugaggggagcuaag

SEQ ID NO: 7213 - RNA, 23 nt, Homo Sapiens
cagggugagggcuaugagggguc

SEQ ID NO: 7214 - RNA, 20 nt, Homo Sapiens
cagggugagauuuccggguc

SEQ ID NO: 7215 - RNA, 20 nt, Homo Sapiens
cagggugagggaacaggguc

SEQ ID NO: 7216 - RNA, 19 nt, Homo Sapiens
gggugaggcaaauacaggg

SEQ ID NO: 7217 - RNA, 17 nt, Homo Sapiens
gggugaggcaggagggu

SEQ ID NO: 7218 - RNA, 21 nt, Homo Sapiens
gugacgaagaaauaagggucc

SEQ ID NO: 7219 - RNA, 20 nt, Homo Sapiens
ucagggugaaggcagcaagg

SEQ ID NO: 7220 - RNA, 19 nt, Homo Sapiens
uccgggugaggcucuucag

SEQ ID NO: 7221 - RNA, 18 nt, Homo Sapiens
ucagggugagggugaagg

SEQ ID NO: 7222 - RNA, 21 nt, Homo Sapiens
ucagggugaggaagaaaaagg

SEQ ID NO: 7223 - RNA, 20 nt, Homo Sapiens
ucagggugaggcucaggggu

SEQ ID NO: 7224 - RNA, 20 nt, Homo Sapiens
uccgggucaggguuaagggu

SEQ ID NO: 7225 - RNA, 19 nt, Homo Sapiens
ucagggugaagaagggccc

SEQ ID NO: 7226 - RNA, 61 nt, Homo Sapiens
ucccgggccaaggggguggccugcacaggcccgaugucuacuugcuugcaccagcccggga

SEQ ID NO: 7227 - RNA, 24 nt, Homo Sapiens
ugucuacuugcuugcaccagcccg

SEQ ID NO: 7228 - RNA, 28 nt, Homo Sapiens
aaggggcaguagccuucugcacagggcc

SEQ ID NO: 7229 - RNA, 19 nt, Homo Sapiens
aaggcuguacccugcacag

SEQ ID NO: 7230 - RNA, 23 nt, Homo Sapiens
aagggggugggcuggcagugccc

SEQ ID NO: 7231 - RNA, 26 nt, Homo Sapiens
agggccuggugugucugcacagggcc

SEQ ID NO: 7232 - RNA, 26 nt, Homo Sapiens
aggggguggcuuccugccacagcgcc

SEQ ID NO: 7233 - RNA, 24 nt, Homo Sapiens
aggggguggggugcacccaugccc

SEQ ID NO: 7234 - RNA, 19 nt, Homo Sapiens
agggggugggcugcagcag

SEQ ID NO: 7235 - RNA, 18 nt, Homo Sapiens
aggggguggccgccaggc

SEQ ID NO: 7236 - RNA, 17 nt, Homo Sapiens
agcggguggcacaggcc

SEQ ID NO: 7237 - RNA, 18 nt, Homo Sapiens
agggagugggcacaggcc

SEQ ID NO: 7238 - RNA, 20 nt, Homo Sapiens
agggggugugugcacaggcc

SEQ ID NO: 7239 - RNA, 21 nt, Homo Sapiens
agggggagccaccacaggccc

SEQ ID NO: 7240 - RNA, 21 nt, Homo Sapiens
agggggugggugggcaggccc

SEQ ID NO: 7241 - RNA, 21 nt, Homo Sapiens
aggggguggggggcgaggccc

SEQ ID NO: 7242 - RNA, 22 nt, Homo Sapiens
caaggagggguuggcacaggcc

SEQ ID NO: 7243 - RNA, 24 nt, Homo Sapiens
caaggcgccggccugcacgggccc

SEQ ID NO: 7244 - RNA, 23 nt, Homo Sapiens
caagggcccagcugcacaggccc

SEQ ID NO: 7245 - RNA, 23 nt, Homo Sapiens
caaggggguaccaugacugcccc

SEQ ID NO: 7246 - RNA, 19 nt, Homo Sapiens
cuacuugcucuaccccagc

SEQ ID NO: 7247 - RNA, 24 nt, Homo Sapiens
ggggguggcggcgcugccgggccc

SEQ ID NO: 7248 - RNA, 22 nt, Homo Sapiens
gggggcggcggcggcacaggcc

SEQ ID NO: 7249 - RNA, 20 nt, Homo Sapiens
ggggguggccugcagacagg

SEQ ID NO: 7250 - RNA, 19 nt, Homo Sapiens
gggacuggccugcaggccc

SEQ ID NO: 7251 - RNA, 24 nt, Homo Sapiens
gggguggccaguucacagcugccc

SEQ ID NO: 7252 - RNA, 18 nt, Homo Sapiens
ggaguugcugcacaggcc

SEQ ID NO: 7253 - RNA, 18 nt, Homo Sapiens
gggguccugcacaggacc

SEQ ID NO: 7254 - RNA, 20 nt, Homo Sapiens
gggagagcaugcacaggccc

SEQ ID NO: 7255 - RNA, 17 nt, Homo Sapiens
ggauggccugcaggccc

SEQ ID NO: 7256 - RNA, 19 nt, Homo Sapiens
gguggccugggcagagccc

SEQ ID NO: 7257 - RNA, 19 nt, Homo Sapiens
uaauuacuuugcaccagcc

SEQ ID NO: 7258 - RNA, 20 nt, Homo Sapiens
uacugaccugcaccagcacg

SEQ ID NO: 7259 - RNA, 22 nt, Homo Sapiens
uccacucugccgcugcaccagc

SEQ ID NO: 7260 - RNA, 19 nt, Homo Sapiens
ugucuacuugccuuaaacc

SEQ ID NO: 7261 - RNA, 19 nt, Homo Sapiens
uguuucuugcuugcaucag

SEQ ID NO: 7262 - RNA, 63 nt, Homo Sapiens
ucccuuuccugaccuuuagucuuucacuuccaauuuguggaaugauauuuuaggaauaacgga

SEQ ID NO: 7263 - RNA, 24 nt, Homo Sapiens
gaaugauauuuuaggaauaacgga

SEQ ID NO: 7264 - RNA, 21 nt, Homo Sapiens
aauaaguauuuuagggaaaac

SEQ ID NO: 7265 - RNA, 21 nt, Homo Sapiens
aaugauauuuuuaggagauaa

SEQ ID NO: 7266 - RNA, 21 nt, Homo Sapiens
aaagauauuuuuaggaaaaac

SEQ ID NO: 7267 - RNA, 19 nt, Homo Sapiens
aauguauuuuagggaaaua

SEQ ID NO: 7268 - RNA, 21 nt, Homo Sapiens
aauuauauuuuaggcaaaaac

SEQ ID NO: 7269 - RNA, 19 nt, Homo Sapiens
aauaauauuuuagggaaaa

SEQ ID NO: 7270 - RNA, 19 nt, Homo Sapiens
aauguuuuuaaggaauaac

SEQ ID NO: 7271 - RNA, 21 nt, Homo Sapiens
auuuuuuaggaagaaaccgga

SEQ ID NO: 7272 - RNA, 24 nt, Homo Sapiens
gaaugauauauauaugcuuaaugg

SEQ ID NO: 7273 - RNA, 69 nt, Homo Sapiens
uccgagggcgagcuccagaaaaguuuugcaaucuggagauaaggagcuugaugggcagcuagacuugga

SEQ ID NO: 7274 - RNA, 24 nt, Homo Sapiens
uaaggagcuugaugggcagcuaga

SEQ ID NO: 7275 - RNA, 24 nt, Homo Sapiens
aagcaggcuugauggucagaaaga

SEQ ID NO: 7276 - RNA, 22 nt, Homo Sapiens
aaagagcccucagugggcagcu

SEQ ID NO: 7277 - RNA, 21 nt, Homo Sapiens
aaggaguaucagugggcagcu

SEQ ID NO: 7278 - RNA, 19 nt, Homo Sapiens
aaggcuuuuuaugggcagc

SEQ ID NO: 7279 - RNA, 23 nt, Homo Sapiens
aaggggauggcagggcagcuaga

SEQ ID NO: 7280 - RNA, 17 nt, Homo Sapiens
aggaggagugggcagcu

SEQ ID NO: 7281 - RNA, 18 nt, Homo Sapiens
agcagguuaugggcagcu

SEQ ID NO: 7282 - RNA, 15 nt, Homo Sapiens
aggagcugggcagcu

SEQ ID NO: 7283 - RNA, 19 nt, Homo Sapiens
aggcaccugcugggcagcu

SEQ ID NO: 7284 - RNA, 19 nt, Homo Sapiens
agguccaugcugggcagcu

SEQ ID NO: 7285 - RNA, 21 nt, Homo Sapiens
aggugcggcugggcagcuaga

SEQ ID NO: 7286 - RNA, 22 nt, Homo Sapiens
ggaacucugugggcagcugaga

SEQ ID NO: 7287 - RNA, 26 nt, Homo Sapiens
uaagcaguugacaucaggcagcuaga

SEQ ID NO: 7288 - RNA, 20 nt, Homo Sapiens
uaaagggcuugauggggagc

SEQ ID NO: 7289 - RNA, 21 nt, Homo Sapiens
uaggaagccccaugggcagcu

SEQ ID NO: 7290 - RNA, 97 nt, Homo Sapiens
uccgcggagguuucggcaguggcauccggggccggggucgcggccguggacggggccggggccgaggccgcggagcucgcggaggcaaggccgagga

SEQ ID NO: 7291 - RNA, 97 nt, Homo Sapiens; identical to SEQ ID NO: 7290

SEQ ID NO: 7292 - RNA, 97 nt, Homo Sapiens; identical to SEQ ID NO: 7290

SEQ ID NO: 7293 - RNA, 97 nt, Homo Sapiens; identical to SEQ ID NO: 7290

SEQ ID NO: 7294 - RNA, 97 nt, Homo Sapiens; identical to SEQ ID NO: 7290

SEQ ID NO: 7295 - RNA, 97 nt, Homo Sapiens; identical to SEQ ID NO: 7290

SEQ ID NO: 7296 - RNA, 97 nt, Homo Sapiens; identical to SEQ ID NO: 7290

SEQ ID NO: 7297 - RNA, 97 nt, Homo Sapiens; identical to SEQ ID NO: 7290

SEQ ID NO: 7298 - RNA, 97 nt, Homo Sapiens; identical to SEQ ID NO: 7290

SEQ ID NO: 7299 - RNA, 97 nt, Homo Sapiens; identical to SEQ ID NO: 7290

SEQ ID NO: 7300 - RNA, 97 nt, Homo Sapiens; identical to SEQ ID NO: 7290

SEQ ID NO: 7301 - RNA, 104 nt, Homo Sapiens
uccggaguaaacggcucuucauuagcuuggaguggccgcaggucccgugaccagcacccgcgagacccugugcgacagcugggcugaugcuccguuucucuggg

SEQ ID NO: 7302 - RNA, 24 nt, Homo Sapiens
uagcuuggaguggccgcagguccc

SEQ ID NO: 7303 - RNA, 27 nt, Homo Sapiens
agcgaggaguggccuuggcgagguccc

SEQ ID NO: 7304 - RNA, 18 nt, Homo Sapiens
cuggggguggcagguccc

SEQ ID NO: 7305 - RNA, 19 nt, Homo Sapiens
gcugggcgguggccgcagg

SEQ ID NO: 7306 - RNA, 19 nt, Homo Sapiens
gcuuggagucggggguccc

SEQ ID NO: 7307 - RNA, 19 nt, Homo Sapiens
ggaguggccgcggccuccc

SEQ ID NO: 7308 - RNA, 24 nt, Homo Sapiens
uagcuuggagggacccgagcuucc

SEQ ID NO: 7309 - RNA, 71 nt, Homo Sapiens
uccguuacugagauuggagugacuuagaagagggugaccuccaugaaagcagguaggaucacagaugcgga

SEQ ID NO: 7310 - RNA, 24 nt, Homo Sapiens
ugaaagcagguaggaucacagaug

SEQ ID NO: 7311 - RNA, 21 nt, Homo Sapiens
aaugcagguaggaggucccag

SEQ ID NO: 7312 - RNA, 21 nt, Homo Sapiens
aaagcagguaagauuaacaga

SEQ ID NO: 7313 - RNA, 18 nt, Homo Sapiens
aaagugcuaggaucacag

SEQ ID NO: 7314 - RNA, 24 nt, Homo Sapiens
aagcagguaagugucagccagaug

SEQ ID NO: 7315 - RNA, 20 nt, Homo Sapiens
aagcagguagggacucccag

SEQ ID NO: 7316 - RNA, 23 nt, Homo Sapiens
aagcagaggacaaaucacagaug

SEQ ID NO: 7317 - RNA, 20 nt, Homo Sapiens
aagcagccaguucacagaug

SEQ ID NO: 7318 - RNA, 21 nt, Homo Sapiens
aaguagcugggaucacaggug

SEQ ID NO: 7319 - RNA, 21 nt, Homo Sapiens
agcaggagggaaucacagaug

SEQ ID NO: 7320 - RNA, 19 nt, Homo Sapiens
gacagcagucaggaucaca

SEQ ID NO: 7321 - RNA, 20 nt, Homo Sapiens
gaaagcaggcagcaugacag

SEQ ID NO: 7322 - RNA, 18 nt, Homo Sapiens
gaaagcaguucacagaug

SEQ ID NO: 7323 - RNA, 77 nt, Homo Sapiens
uccuccaucccagcauagagaauggggacucccugaguaaugggaguucuuucauguccucugcuugggguggggga

SEQ ID NO: 7324 - RNA, 24 nt, Homo Sapiens
ucccagcauagagaauggggacuc

SEQ ID NO: 7325 - RNA, 21 nt, Homo Sapiens
cagcacacagaauggggaauc

SEQ ID NO: 7326 - RNA, 23 nt, Homo Sapiens
cauagagcagggcauggggacuc

SEQ ID NO: 7327 - RNA, 20 nt, Homo Sapiens
ccaacagguggagaaugggg

SEQ ID NO: 7328 - RNA, 25 nt, Homo Sapiens
ccaucacuaagagaaugggcaucuc

SEQ ID NO: 7329 - RNA, 22 nt, Homo Sapiens
ccugcauggaaaagaaugggga

SEQ ID NO: 7330 - RNA, 23 nt, Homo Sapiens
cccaugccagagagaauggugac

SEQ ID NO: 7331 - RNA, 24 nt, Homo Sapiens
cccagcucgguaggggaaugggga

SEQ ID NO: 7332 - RNA, 24 nt, Homo Sapiens
cccugaacagagaauggaggccuc

SEQ ID NO: 7333 - RNA, 19 nt, Homo Sapiens
ucccagcauggccaauggg

SEQ ID NO: 7334 - RNA, 19 nt, Homo Sapiens
ucccauuacugagaauggg

SEQ ID NO: 7335 - RNA, 19 nt, Homo Sapiens
ucccugcuacagaaugggg

SEQ ID NO: 7336 - RNA, 25 nt, Homo Sapiens
uccccggagaacgaauggggaacuc

SEQ ID NO: 7337 - RNA, 20 nt, Homo Sapiens
ucccagcaugggcaggggac

SEQ ID NO: 7338 - RNA, 100 nt, Homo Sapiens
ucgucaauggaagaaccgccuuucggggcguuggaccuuccaauucccggucagauggagaaccagcgcaguacccgagaaaagggucgcccguugacga

SEQ ID NO: 7339 - RNA, 24 nt, Homo Sapiens
uggagaaccagcgcaguacccgag

SEQ ID NO: 7340 - RNA, 17 nt, Homo Sapiens
agaaccagcuguaaccg

SEQ ID NO: 7341 - RNA, 19 nt, Homo Sapiens
agaaccagccagagcugag

SEQ ID NO: 7342 - RNA, 18 nt, Homo Sapiens
agaacgaaaguacccgag

SEQ ID NO: 7343 - RNA, 20 nt, Homo Sapiens
ggagaaccagucucggugcc

SEQ ID NO: 7344 - RNA, 27 nt, Homo Sapiens
ggagaaacagaugggcaguacccugag

SEQ ID NO: 7345 - RNA, 19 nt, Homo Sapiens
ggagaaccacccgaacccg

SEQ ID NO: 7346 - RNA, 22 nt, Homo Sapiens
uggagacuacaaugcaguaccc

SEQ ID NO: 7347 - RNA, 21 nt, Homo Sapiens
uggagaaccaagacuguaucc

SEQ ID NO: 7348 - RNA, 70 nt, Homo Sapiens
ucuaucauaagaaguggacagcacgaaacuugugaaaccaaugugccuuuaaacuucuaauaugcuuaga

SEQ ID NO: 7349 - RNA, 24 nt, Homo Sapiens
uaagaaguggacagcacgaaacuu

SEQ ID NO: 7350 - RNA, 24 nt, Homo Sapiens
aagauggacauuuucacgaaacuu

SEQ ID NO: 7351 - RNA, 20 nt, Homo Sapiens
aagaaguggguaagacggaa

SEQ ID NO: 7352 - RNA, 20 nt, Homo Sapiens
aagaaguggcaguaacaaac

SEQ ID NO: 7353 - RNA, 21 nt, Homo Sapiens
aagaaguggaaagugcggaac

SEQ ID NO: 7354 - RNA, 20 nt, Homo Sapiens
agaaguggaaagacaugaaa

SEQ ID NO: 7355 - RNA, 23 nt, Homo Sapiens
agaaguggacucuacugaaccuu

SEQ ID NO: 7356 - RNA, 20 nt, Homo Sapiens
gaagcuggacagcagggaac

SEQ ID NO: 7357 - RNA, 21 nt, Homo Sapiens
gaaguggacgccgcaggcaac

SEQ ID NO: 7358 - RNA, 21 nt, Homo Sapiens
gaacuggcuaugacgaaacuu

SEQ ID NO: 7359 - RNA, 24 nt, Homo Sapiens
uaagaagugaggggcaggaugaaa

SEQ ID NO: 7360 - RNA, 21 nt, Homo Sapiens
uaagaaguggagaggaagaaa

SEQ ID NO: 7361 - RNA, 92 nt, Homo Sapiens
ucucccucaggaccagcugucaguccccaggcccugagguggugccugcauccuaggucuguggggcauuacuggugucacucugagggaga

SEQ ID NO: 7362 - RNA, 24 nt, Homo Sapiens
ugucaguccccaggcccugaggug

SEQ ID NO: 7363 - RNA, 20 nt, Homo Sapiens
cagcccccaggcccuugagg

SEQ ID NO: 7364 - RNA, 19 nt, Homo Sapiens
cagcccccaggccugaggu

SEQ ID NO: 7365 - RNA, 20 nt, Homo Sapiens
caguccccagcccuauggug

SEQ ID NO: 7366 - RNA, 23 nt, Homo Sapiens
gucuguccuuccuggcccugagg

SEQ ID NO: 7367 - RNA, 19 nt, Homo Sapiens
gucaguccccuuccugagg

SEQ ID NO: 7368 - RNA, 21 nt, Homo Sapiens
ucaguccccacaggcccauga

SEQ ID NO: 7369 - RNA, 22 nt, Homo Sapiens
ucaauccacauagcccugaggu

SEQ ID NO: 7370 - RNA, 18 nt, Homo Sapiens
ucaguccccagcccagag

SEQ ID NO: 7371 - RNA, 21 nt, Homo Sapiens
ucagcccaggcccagagcgug

SEQ ID NO: 7372 - RNA, 19 nt, Homo Sapiens
ucauccccaggccuugagg

SEQ ID NO: 7373 - RNA, 20 nt, Homo Sapiens
ucaguccccagcacugaggu

SEQ ID NO: 7374 - RNA, 19 nt, Homo Sapiens
uccccaggccccacaggug

SEQ ID NO: 7375 - RNA, 20 nt, Homo Sapiens
ugucugguccccaggcgcug

SEQ ID NO: 7376 - RNA, 23 nt, Homo Sapiens
ugucagucccgcggcuggcccug

SEQ ID NO: 7377 - RNA, 19 nt, Homo Sapiens
ugacaguccccagagccug

SEQ ID NO: 7378 - RNA, 20 nt, Homo Sapiens
uggcaguccccaucccugag

SEQ ID NO: 7379 - RNA, 21 nt, Homo Sapiens
uguucgucuccgggcccugag

SEQ ID NO: 7380 - RNA, 65 nt, Homo Sapiens
ucugacagcagccauuauccugcuccauaccuuuuggggaguuguguucuuugaugccugugaga

SEQ ID NO: 7381 - RNA, 24 nt, Homo Sapiens
ugacagcagccauuauccugcucc

SEQ ID NO: 7382 - RNA, 19 nt, Homo Sapiens
acagcagccuuauuaaccu

SEQ ID NO: 7383 - RNA, 19 nt, Homo Sapiens
cagcagccacgucuccugc

SEQ ID NO: 7384 - RNA, 22 nt, Homo Sapiens
caucagccauuaucacuggucc

SEQ ID NO: 7385 - RNA, 21 nt, Homo Sapiens
cagacgcauuuuuccugcucc

SEQ ID NO: 7386 - RNA, 21 nt, Homo Sapiens
ugagcagcagccaucuccagc

SEQ ID NO: 7387 - RNA, 20 nt, Homo Sapiens
ugacagcaguaaaccauuau

SEQ ID NO: 7388 - RNA, 27 nt, Homo Sapiens
ugccagcagccacguaucucuugaucc

SEQ ID NO: 7389 - RNA, 21 nt, Homo Sapiens
ugucagcagccagcuguccug

SEQ ID NO: 7390 - RNA, 18 nt, Homo Sapiens
ugacagcagccucaccug

SEQ ID NO: 7391 - RNA, 19 nt, Homo Sapiens
ugacagcaggcuuacuugc

SEQ ID NO: 7392 - RNA, 19 nt, Homo Sapiens
ugacagcagaugaccuccu

SEQ ID NO: 7393 - RNA, 22 nt, Homo Sapiens
ugacagcagcucccccuggucc

SEQ ID NO: 7394 - RNA, 21 nt, Homo Sapiens
ugacagcagccucuccucucc

SEQ ID NO: 7395 - RNA, 61 nt, Homo Sapiens
ucugacagggcccaugucccacaaggcugcuuggccucagugggugcuuggcugugcugga

SEQ ID NO: 7396 - RNA, 24 nt, Homo Sapiens
ugacagggcccaugucccacaagg

SEQ ID NO: 7397 - RNA, 24 nt, Homo Sapiens
acagggccccauuucuucagaagg

SEQ ID NO: 7398 - RNA, 18 nt, Homo Sapiens
acagagacugucccacaa

SEQ ID NO: 7399 - RNA, 19 nt, Homo Sapiens
acagggcccucccacaggg

SEQ ID NO: 7400 - RNA, 20 nt, Homo Sapiens
agggcccauggcagagaagg

SEQ ID NO: 7401 - RNA, 21 nt, Homo Sapiens
caggagcccaggcccacaagg

SEQ ID NO: 7402 - RNA, 20 nt, Homo Sapiens
cagagcccucgaugucccac

SEQ ID NO: 7403 - RNA, 22 nt, Homo Sapiens
cagggcccaguuguuccuccag

SEQ ID NO: 7404 - RNA, 21 nt, Homo Sapiens
cagggcccagccucccagaag

SEQ ID NO: 7405 - RNA, 23 nt, Homo Sapiens
cagggcccaucaccagcaccagg

SEQ ID NO: 7406 - RNA, 20 nt, Homo Sapiens
cagggcccagacucaaaagg

SEQ ID NO: 7407 - RNA, 20 nt, Homo Sapiens
cagggcccagugccuccagg

SEQ ID NO: 7408 - RNA, 21 nt, Homo Sapiens
cagggcccagggcccuccagg

SEQ ID NO: 7409 - RNA, 21 nt, Homo Sapiens
cagggcccaggucccccaggg

SEQ ID NO: 7410 - RNA, 18 nt, Homo Sapiens
gacagggccugucaccca

SEQ ID NO: 7411 - RNA, 20 nt, Homo Sapiens
gacagggcccaucacagagg

SEQ ID NO: 7412 - RNA, 20 nt, Homo Sapiens
gacaggcaugucccagaugg

SEQ ID NO: 7413 - RNA, 22 nt, Homo Sapiens
gacagggcccuguucuccaagg

SEQ ID NO: 7414 - RNA, 21 nt, Homo Sapiens
gggccucaguuucccacaagg

SEQ ID NO: 7415 - RNA, 19 nt, Homo Sapiens
gggcccuaaugucccacaa

SEQ ID NO: 7416 - RNA, 22 nt, Homo Sapiens
gggcccaugaacauccccaagg

SEQ ID NO: 7417 - RNA, 21 nt, Homo Sapiens
ggggccuuuucccccacaagg

SEQ ID NO: 7418 - RNA, 23 nt, Homo Sapiens
ugucaggagcaccuugucccaca

SEQ ID NO: 7419 - RNA, 24 nt, Homo Sapiens
ugacagggcagccacguucaagaa

SEQ ID NO: 7420 - RNA, 25 nt, Homo Sapiens
ugacuguccaccaugucccagaagg

SEQ ID NO: 7421 - RNA, 25 nt, Homo Sapiens
ugacagggcccuaagccgcacaagg

SEQ ID NO: 7422 - RNA, 24 nt, Homo Sapiens
ugacagggcucuugagauccaaca

SEQ ID NO: 7423 - RNA, 21 nt, Homo Sapiens
ugacagggcugugucaccaca

SEQ ID NO: 7424 - RNA, 24 nt, Homo Sapiens
ugacagggccaaauccggcacaag

SEQ ID NO: 7425 - RNA, 18 nt, Homo Sapiens
ugccagacccauguccca

SEQ ID NO: 7426 - RNA, 20 nt, Homo Sapiens
ugacucgugccaugucccac

SEQ ID NO: 7427 - RNA, 20 nt, Homo Sapiens
ugucagggcccagcccgaca

SEQ ID NO: 7428 - RNA, 23 nt, Homo Sapiens
uggcagggucagugcccacaagg

SEQ ID NO: 7429 - RNA, 77 nt, Homo Sapiens
ucuggcugcagaucuggagguggaggcaguacccuggacucuauucugcugccccuucaggguuuggaggagccgga

SEQ ID NO: 7430 - RNA, 24 nt, Homo Sapiens
cugcagaucuggagguggaggcag

SEQ ID NO: 7431 - RNA, 19 nt, Homo Sapiens
agaugguagagguggaggc

SEQ ID NO: 7432 - RNA, 19 nt, Homo Sapiens
agacuggagguggacacag

SEQ ID NO: 7433 - RNA, 22 nt, Homo Sapiens
cagagcauggggauggaggcag

SEQ ID NO: 7434 - RNA, 23 nt, Homo Sapiens
cagagcugccgggcuggaggcag

SEQ ID NO: 7435 - RNA, 19 nt, Homo Sapiens
cagagaaggagguggaugc

SEQ ID NO: 7436 - RNA, 25 nt, Homo Sapiens
cugcuaaaaccugaaguggaggcag

SEQ ID NO: 7437 - RNA, 28 nt, Homo Sapiens
cugcagaguccgcagagggguggaggca

SEQ ID NO: 7438 - RNA, 28 nt, Homo Sapiens
cugcagaucaaugauaaggugcaggcag

SEQ ID NO: 7439 - RNA, 24 nt, Homo Sapiens
cuggagagcccaggagguggaggc

SEQ ID NO: 7440 - RNA, 25 nt, Homo Sapiens
cugcacagccggcggcuggaggcag

SEQ ID NO: 7441 - RNA, 21 nt, Homo Sapiens
cugcagaucggggcugggggc

SEQ ID NO: 7442 - RNA, 24 nt, Homo Sapiens
cuccagccccgaagguggaggaag

SEQ ID NO: 7443 - RNA, 20 nt, Homo Sapiens
cugaagaucuggagaggcag

SEQ ID NO: 7444 - RNA, 24 nt, Homo Sapiens
cugcagagagggagguggaggaag

SEQ ID NO: 7445 - RNA, 24 nt, Homo Sapiens
cugcagaucuagagguuguagcag

SEQ ID NO: 7446 - RNA, 22 nt, Homo Sapiens
gaucucaggaaaauggaggcag

SEQ ID NO: 7447 - RNA, 23 nt, Homo Sapiens
gcagucugcgagguggagagcag

SEQ ID NO: 7448 - RNA, 24 nt, Homo Sapiens
gcaggugggggcagguggaggcag

SEQ ID NO: 7449 - RNA, 20 nt, Homo Sapiens
gcugaccugggagguggagg

SEQ ID NO: 7450 - RNA, 21 nt, Homo Sapiens
gcaaucuggaggggcagggag

SEQ ID NO: 7451 - RNA, 23 nt, Homo Sapiens
ugcaguugcuguaguggaggcag

SEQ ID NO: 7452 - RNA, 20 nt, Homo Sapiens
ugcugguuugaagguggagg

SEQ ID NO: 7453 - RNA, 20 nt, Homo Sapiens
ugcagguggcgguggaggca

SEQ ID NO: 7454 - RNA, 19 nt, Homo Sapiens
uggacaucugguggaggca

SEQ ID NO: 7455 - RNA, 19 nt, Homo Sapiens
ugcagggagguggagggag

SEQ ID NO: 7456 - RNA, 20 nt, Homo Sapiens
uggagaggagguggagggag

SEQ ID NO: 7457 - RNA, 96 nt, Homo Sapiens
ucuguuauaacaucucaacuuaccuguugccacuuggaauauauaucgauacauuauggugccgagugguaacaugggaguguuugauccaacaga

SEQ ID NO: 7458 - RNA, 24 nt, Homo Sapiens
ucucaacuuaccuguugccacuug

SEQ ID NO: 7459 - RNA, 19 nt, Homo Sapiens
caaccacgccguugccacu

SEQ ID NO: 7460 - RNA, 20 nt, Homo Sapiens
cucagcucugaugccacuug

SEQ ID NO: 7461 - RNA, 21 nt, Homo Sapiens
ucacaucuuguuccuguugcc

SEQ ID NO: 7462 - RNA, 20 nt, Homo Sapiens
ucucagucacuuguugccac

SEQ ID NO: 7463 - RNA, 67 nt, Homo Sapiens
ucuuggcgcgcggcacugggagccgcgggccgagccugucaagccccgcagcagcagcgcgucagga

SEQ ID NO: 7464 - RNA, 24 nt, Homo Sapiens
ugucaagccccgcagcagcagcgc

SEQ ID NO: 7465 - RNA, 21 nt, Homo Sapiens
aagcggcggcagcagcaccgc

SEQ ID NO: 7466 - RNA, 20 nt, Homo Sapiens
agccacagagcagcagcagc

SEQ ID NO: 7467 - RNA, 19 nt, Homo Sapiens
agacccaggcagcagcagc

SEQ ID NO: 7468 - RNA, 25 nt, Homo Sapiens
gucaagacgcuggggcagcagcagc

SEQ ID NO: 7469 - RNA, 23 nt, Homo Sapiens
guccagccaagagcagcagcagc

SEQ ID NO: 7470 - RNA, 21 nt, Homo Sapiens
gucuggccccgcagcagcagc

SEQ ID NO: 7471 - RNA, 21 nt, Homo Sapiens
gucaagcccccaagccagggc

SEQ ID NO: 7472 - RNA, 23 nt, Homo Sapiens
ucuagccacagccagcagcagcg

SEQ ID NO: 7473 - RNA, 21 nt, Homo Sapiens
ucacgccacagcagcagcagc

SEQ ID NO: 7474 - RNA, 23 nt, Homo Sapiens
uccagccccgaccccagcagcag

SEQ ID NO: 7475 - RNA, 17 nt, Homo Sapiens
ucaagucccagcagcag

SEQ ID NO: 7476 - RNA, 18 nt, Homo Sapiens
ucaagccccagcugcagc

SEQ ID NO: 7477 - RNA, 20 nt, Homo Sapiens
ucaggagcagcagcagcagc

SEQ ID NO: 7478 - RNA, 21 nt, Homo Sapiens
uguccgagaccugcagcagca

SEQ ID NO: 7479 - RNA, 22 nt, Homo Sapiens
ugucagccggcaggcagcagcg

SEQ ID NO: 7480 - RNA, 20 nt, Homo Sapiens
ugucaagcccagaggcacca

SEQ ID NO: 7481 - RNA, 75 nt, Homo Sapiens
ucuugggaacuggaguaaaggucacucuugcuacgcuuuagcagagacugguggcauuuugccccugcccugaga

SEQ ID NO: 7482 - RNA, 24 nt, Homo Sapiens
agcagagacugguggcauuuugcc

SEQ ID NO: 7483 - RNA, 18 nt, Homo Sapiens
agcagagacuuuggaauu

SEQ ID NO: 7484 - RNA, 19 nt, Homo Sapiens
agcagagacuggacggauu

SEQ ID NO: 7485 - RNA, 18 nt, Homo Sapiens
agcaggccgguggcauuu

SEQ ID NO: 7486 - RNA, 20 nt, Homo Sapiens
agcagaggccuggcauuuug

SEQ ID NO: 7487 - RNA, 23 nt, Homo Sapiens
cagaggcaucauggcauuuuacc

SEQ ID NO: 7488 - RNA, 17 nt, Homo Sapiens
cagagacuuggcauuuu

SEQ ID NO: 7489 - RNA, 21 nt, Homo Sapiens
gaggcugggacaggcauuuug

SEQ ID NO: 7490 - RNA, 19 nt, Homo Sapiens
gagacugguggcuucgugc

SEQ ID NO: 7491 - RNA, 20 nt, Homo Sapiens
gcagagacucccagcauuuu

SEQ ID NO: 7492 - RNA, 19 nt, Homo Sapiens
gcaagacugguguuuuugc

SEQ ID NO: 7493 - RNA, 63 nt, Homo Sapiens
ucuuggugacaaaauauguuguguagaguucaggggagagugcgucauauguuguuccuagga

SEQ ID NO: 7494 - RNA, 24 nt, Homo Sapiens
ugacaaaauauguuguguagaguu

SEQ ID NO: 7495 - RNA, 20 nt, Homo Sapiens
aaaaguuuauguguagaguu

SEQ ID NO: 7496 - RNA, 20 nt, Homo Sapiens
aaaauauguaguguaaaauu

SEQ ID NO: 7497 - RNA, 19 nt, Homo Sapiens
aacaaauuuuuguagaguu

SEQ ID NO: 7498 - RNA, 21 nt, Homo Sapiens
aaauauguuaaguuuugaguu

SEQ ID NO: 7499 - RNA, 20 nt, Homo Sapiens
aaauauguugauuuggaauu

SEQ ID NO: 7500 - RNA, 18 nt, Homo Sapiens
aaauauguugugugaguu

SEQ ID NO: 7501 - RNA, 19 nt, Homo Sapiens
aauauguugaaucuagagu

SEQ ID NO: 7502 - RNA, 21 nt, Homo Sapiens
acaaaauaugucgcuaaagag

SEQ ID NO: 7503 - RNA, 19 nt, Homo Sapiens
acaaaauauauguccuaga

SEQ ID NO: 7504 - RNA, 19 nt, Homo Sapiens
caagauuuauuguguagag

SEQ ID NO: 7505 - RNA, 20 nt, Homo Sapiens
gacaauuuauauguguagag

SEQ ID NO: 7506 - RNA, 25 nt, Homo Sapiens
ugacggaaaggaagcuuguguagag

SEQ ID NO: 7507 - RNA, 24 nt, Homo Sapiens
ugacaaaauacuggaguguuaguu

SEQ ID NO: 7508 - RNA, 25 nt, Homo Sapiens
ugaagaaauaguuacauguagaguu

SEQ ID NO: 7509 - RNA, 19 nt, Homo Sapiens
ugacaaaauauuaugggua

SEQ ID NO: 7510 - RNA, 19 nt, Homo Sapiens
ugagagaaaauuguguaga

SEQ ID NO: 7511 - RNA, 80 nt, Homo Sapiens
ucuuguguugagacuucgugguggugcuaagaaaaggaagaagaagucuuacaccacucccaagaagaauaagcacaaga

SEQ ID NO: 7512 - RNA, 24 nt, Homo Sapiens
uacaccacucccaagaagaauaag

SEQ ID NO: 7513 - RNA, 19 nt, Homo Sapiens
acagcagcagccaagaaga

SEQ ID NO: 7514 - RNA, 19 nt, Homo Sapiens
acaccacucccacacgaag

SEQ ID NO: 7515 - RNA, 16 nt, Homo Sapiens
acaccaccaagaagaa

SEQ ID NO: 7516 - RNA, 23 nt, Homo Sapiens
acaacacucccaagaauuuuaag

SEQ ID NO: 7517 - RNA, 24 nt, Homo Sapiens
acccuccccccaaaaaagaauaag

SEQ ID NO: 7518 - RNA, 20 nt, Homo Sapiens
acuauuuccaagaagaagaa

SEQ ID NO: 7519 - RNA, 20 nt, Homo Sapiens
agagcuucguggugugagcu

SEQ ID NO: 7520 - RNA, 21 nt, Homo Sapiens
agaccuucguggugaguguua

SEQ ID NO: 7521 - RNA, 19 nt, Homo Sapiens
agaauuccaaguggugcua

SEQ ID NO: 7522 - RNA, 19 nt, Homo Sapiens
caccacuccucccaagaag

SEQ ID NO: 7523 - RNA, 25 nt, Homo Sapiens
caucagucccauauaaaagaauaag

SEQ ID NO: 7524 - RNA, 22 nt, Homo Sapiens
caccacuccaagaaaagaaaaa

SEQ ID NO: 7525 - RNA, 21 nt, Homo Sapiens
caccacuccuaaguaaacaau

SEQ ID NO: 7526 - RNA, 19 nt, Homo Sapiens
cacucccaacugcagaaua

SEQ ID NO: 7527 - RNA, 21 nt, Homo Sapiens
ccacuaucccaagaagaaaaa

SEQ ID NO: 7528 - RNA, 23 nt, Homo Sapiens
ccacucccaagaguccagaacaa

SEQ ID NO: 7529 - RNA, 21 nt, Homo Sapiens
ccaaucccaagaaugaaugag

SEQ ID NO: 7530 - RNA, 20 nt, Homo Sapiens
ccacucccaccaagacaaag

SEQ ID NO: 7531 - RNA, 20 nt, Homo Sapiens
cuuagugaaauggugcuaag

SEQ ID NO: 7532 - RNA, 19 nt, Homo Sapiens
cuuccccguggugcuagga

SEQ ID NO: 7533 - RNA, 21 nt, Homo Sapiens
gacuuagacuugggugcuaag

SEQ ID NO: 7534 - RNA, 24 nt, Homo Sapiens
uacaccacuuacaguaaguaauaa

SEQ ID NO: 7535 - RNA, 18 nt, Homo Sapiens
uaaaccacgccaagaaga

SEQ ID NO: 7536 - RNA, 21 nt, Homo Sapiens
uacacugcucccaagaacaau

SEQ ID NO: 7537 - RNA, 21 nt, Homo Sapiens
uauaccuuuuucaagaagaau

SEQ ID NO: 7538 - RNA, 22 nt, Homo Sapiens
ugagacacgauccuggugcuaa

SEQ ID NO: 7539 - RNA, 18 nt, Homo Sapiens
ugagacuuccugggcugc

SEQ ID NO: 7540 - RNA, 22 nt, Homo Sapiens
ugauaauuaguaguggugcuaa

SEQ ID NO: 7541 - RNA, 84 nt, Homo Sapiens
ucuuguucaacauaggguagguggcagccacggguccaacucgcuugaggcugggcccugggcgcuccauuuuguguuccagga

SEQ ID NO: 7542 - RNA, 24 nt, Homo Sapiens
uaggguagguggcagccacggguc

SEQ ID NO: 7543 - RNA, 23 nt, Homo Sapiens
agggcugggaggcggccacgggu

SEQ ID NO: 7544 - RNA, 22 nt, Homo Sapiens
aggguagguagcugcagccgcg

SEQ ID NO: 7545 - RNA, 19 nt, Homo Sapiens
aggggcgguggcagccacg

SEQ ID NO: 7546 - RNA, 20 nt, Homo Sapiens
aggggagguggcaggcaggg

SEQ ID NO: 7547 - RNA, 20 nt, Homo Sapiens
aggugagauggcagccaugg

SEQ ID NO: 7548 - RNA, 23 nt, Homo Sapiens
aggguaggugacaggccugguuc

SEQ ID NO: 7549 - RNA, 20 nt, Homo Sapiens
agguggcagcacccccgguc

SEQ ID NO: 7550 - RNA, 20 nt, Homo Sapiens
gggugugugggcagccacgg

SEQ ID NO: 7551 - RNA, 20 nt, Homo Sapiens
gggcugguggcagcccaggg

SEQ ID NO: 7552 - RNA, 20 nt, Homo Sapiens
ggggagguggcaggcggggg

SEQ ID NO: 7553 - RNA, 20 nt, Homo Sapiens
ggggagguggcagggagggg

SEQ ID NO: 7554 - RNA, 20 nt, Homo Sapiens
ggguagguggcggcugcggg

SEQ ID NO: 7555 - RNA, 20 nt, Homo Sapiens
ggcagguggcagcucagggg

SEQ ID NO: 7556 - RNA, 20 nt, Homo Sapiens
ggcagguggcagcucugguc

SEQ ID NO: 7557 - RNA, 21 nt, Homo Sapiens
gguggccgggacccacggguc

SEQ ID NO: 7558 - RNA, 21 nt, Homo Sapiens
uaggcuguagaggcagccacg

SEQ ID NO: 7559 - RNA, 22 nt, Homo Sapiens
uagggcuugcuggagccacggg

SEQ ID NO: 7560 - RNA, 18 nt, Homo Sapiens
uagcuggcagccaguguc

SEQ ID NO: 7561 - RNA, 72 nt, Homo Sapiens
ucuuuauagcaguaugagaaugaacuaacacaguaaauugguacugcggagaguagaguauugcuauaaaga

SEQ ID NO: 7562 - RNA, 24 nt, Homo Sapiens
uagcaguaugagaaugaacuaaca

SEQ ID NO: 7563 - RNA, 19 nt, Homo Sapiens
agcaaugaaagagaaugaa

SEQ ID NO: 7564 - RNA, 20 nt, Homo Sapiens
agcaguaugagcaaaaagaa

SEQ ID NO: 7565 - RNA, 23 nt, Homo Sapiens
agaaggaugaaugaacugaaaca

SEQ ID NO: 7566 - RNA, 20 nt, Homo Sapiens
aguaagagcauaugaacuaa

SEQ ID NO: 7567 - RNA, 19 nt, Homo Sapiens
aguaugagaauacaaacua

SEQ ID NO: 7568 - RNA, 19 nt, Homo Sapiens
agcaugagaaugacucuaa

SEQ ID NO: 7569 - RNA, 20 nt, Homo Sapiens
aguaugagaauaaacuaaca

SEQ ID NO: 7570 - RNA, 20 nt, Homo Sapiens
cauucugcagaaugaacuaa

SEQ ID NO: 7571 - RNA, 20 nt, Homo Sapiens
gcagucucugugaaugaacu

SEQ ID NO: 7572 - RNA, 19 nt, Homo Sapiens
guuugagaaugaacaacca

SEQ ID NO: 7573 - RNA, 21 nt, Homo Sapiens
uagcagaagauaagaaugaac

SEQ ID NO: 7574 - RNA, 20 nt, Homo Sapiens
uagcaaaaauagagaaugaa

SEQ ID NO: 7575 - RNA, 24 nt, Homo Sapiens
uaccaggauacaugaaugaacuaa

SEQ ID NO: 7576 - RNA, 19 nt, Homo Sapiens
uagagaaugcagaaugaac

SEQ ID NO: 7577 - RNA, 22 nt, Homo Sapiens
uaggauuaugagaauauuaaca

SEQ ID NO: 7578 - RNA, 77 nt, Homo Sapiens
ugaacugaaugagagagaaaaagagguccagaguaguuuguggagcgauguuuccaucucuaaugccacucagcuca

SEQ ID NO: 7579 - RNA, 24 nt, Homo Sapiens
ugagagagaaaaagagguccagag

SEQ ID NO: 7580 - RNA, 20 nt, Homo Sapiens
agagaaaaagaugaccauag

SEQ ID NO: 7581 - RNA, 24 nt, Homo Sapiens
agaaggaaaaagaggcuccaagag

SEQ ID NO: 7582 - RNA, 19 nt, Homo Sapiens
agggagugaaagaggucca

SEQ ID NO: 7583 - RNA, 22 nt, Homo Sapiens
agagggaaacugagguccagag

SEQ ID NO: 7584 - RNA, 21 nt, Homo Sapiens
agugagaaacgugguccagag

SEQ ID NO: 7585 - RNA, 19 nt, Homo Sapiens
gaggaaacugagguccaga

SEQ ID NO: 7586 - RNA, 20 nt, Homo Sapiens
gagagaaaaagaauccacag

SEQ ID NO: 7587 - RNA, 21 nt, Homo Sapiens
gagagagaaaggcaaagaggu

SEQ ID NO: 7588 - RNA, 25 nt, Homo Sapiens
gagagagaaagacagagggagagag

SEQ ID NO: 7589 - RNA, 23 nt, Homo Sapiens
gagggagaaaaagaauagcucca

SEQ ID NO: 7590 - RNA, 23 nt, Homo Sapiens
gagagagaaagagagagugagag

SEQ ID NO: 7591 - RNA, 18 nt, Homo Sapiens
gagagaguaaagaggucc

SEQ ID NO: 7592 - RNA, 19 nt, Homo Sapiens
gagagagaaaauggucaag

SEQ ID NO: 7593 - RNA, 20 nt, Homo Sapiens
gagcgagacaagguccagag

SEQ ID NO: 7594 - RNA, 25 nt, Homo Sapiens
ugagagagacaaaaugagcugaaga

SEQ ID NO: 7595 - RNA, 21 nt, Homo Sapiens
ugagagggaaagaaaagaggu

SEQ ID NO: 7596 - RNA, 20 nt, Homo Sapiens
ugagagagaaaacaggaguc

SEQ ID NO: 7597 - RNA, 23 nt, Homo Sapiens
ugagagagagaagggcaggcaga

SEQ ID NO: 7598 - RNA, 20 nt, Homo Sapiens
ugagagagaaaaaggggacc

SEQ ID NO: 7599 - RNA, 20 nt, Homo Sapiens
ugagagcuagaaagaggucc

SEQ ID NO: 7600 - RNA, 21 nt, Homo Sapiens
ugagagagaaaguggguccag

SEQ ID NO: 7601 - RNA, 20 nt, Homo Sapiens
ugagagagauaaaaauccag

SEQ ID NO: 7602 - RNA, 91 nt, Homo Sapiens
ugaauggccgcucgccgagugcuguuugcaaacuuaggaacccccucgcgcggggccuagcggggguacguggcgcaugcgguaacacuca

SEQ ID NO: 7603 - RNA, 24 nt, Homo Sapiens
uagcggggguacguggcgcaugcg

SEQ ID NO: 7604 - RNA, 24 nt, Homo Sapiens
agcgcuggcgcugcggcgcaugcg

SEQ ID NO: 7605 - RNA, 18 nt, Homo Sapiens
agcgggggucuugggcau

SEQ ID NO: 7606 - RNA, 22 nt, Homo Sapiens
agcugggcaugguggcgcaugc

SEQ ID NO: 7607 - RNA, 22 nt, Homo Sapiens
cggggagagcgcuggcgcugcg

SEQ ID NO: 7608 - RNA, 19 nt, Homo Sapiens
cugauuugcaaacuugaac

SEQ ID NO: 7609 - RNA, 19 nt, Homo Sapiens
gcuggagugccguggcgca

SEQ ID NO: 7610 - RNA, 19 nt, Homo Sapiens
gcggggguaccuccgaugc

SEQ ID NO: 7611 - RNA, 18 nt, Homo Sapiens
gggcgugguggcgcaugc

SEQ ID NO: 7612 - RNA, 18 nt, Homo Sapiens
gugcuuuugcaaacuaag

SEQ ID NO: 7613 - RNA, 19 nt, Homo Sapiens
gugcuguuugcuaaaucag

SEQ ID NO: 7614 - RNA, 22 nt, Homo Sapiens
gugcuguuucucacgaggaacc

SEQ ID NO: 7615 - RNA, 23 nt, Homo Sapiens
uagccagguguaguggcgcaugc

SEQ ID NO: 7616 - RNA, 23 nt, Homo Sapiens
uagcugggauuacaggcgcaugc

SEQ ID NO: 7617 - RNA, 23 nt, Homo Sapiens
uagcagggcaugguggcgcaugc

SEQ ID NO: 7618 - RNA, 22 nt, Homo Sapiens
ugcagucuugcaaacugaguaa

SEQ ID NO: 7619 - RNA, 22 nt, Homo Sapiens
ugcugcuucccaaacuuagaaa

SEQ ID NO: 7620 - RNA, 22 nt, Homo Sapiens
ugcuguuugcucugaaggaacc

SEQ ID NO: 7621 - RNA, 20 nt, Homo Sapiens
ugcuguuuggaacuucugaa

SEQ ID NO: 7622 - RNA, 61 nt, Homo Sapiens
ugagcugacuguguccugccaaggcaguggcugcccaaggaagccugcauaggagaucuca

SEQ ID NO: 7623 - RNA, 24 nt, Homo Sapiens
ggcugcccaaggaagccugcauag

SEQ ID NO: 7624 - RNA, 18 nt, Homo Sapiens
cuuccgcaaggaagcugc

SEQ ID NO: 7625 - RNA, 20 nt, Homo Sapiens
cugcccaagggagugcagag

SEQ ID NO: 7626 - RNA, 19 nt, Homo Sapiens
gcugcccaaugccauccug

SEQ ID NO: 7627 - RNA, 21 nt, Homo Sapiens
ggcuuugcaaggaagccggca

SEQ ID NO: 7628 - RNA, 67 nt, Homo Sapiens
ugaguauagcaaaggacuaagauauuuucuucuugaagagacuuuucgauuaguccucauauauuua

SEQ ID NO: 7629 - RNA, 24 nt, Homo Sapiens
uagcaaaggacuaagauauuuucu

SEQ ID NO: 7630 - RNA, 20 nt, Homo Sapiens
aaaggacuaauaaaauuuuc

SEQ ID NO: 7631 - RNA, 28 nt, Homo Sapiens
agcaaaggaaaacaaagauacuauuucu

SEQ ID NO: 7632 - RNA, 18 nt, Homo Sapiens
agcaaaggaagaauguuc

SEQ ID NO: 7633 - RNA, 22 nt, Homo Sapiens
agcaaaggaugagauacauucu

SEQ ID NO: 7634 - RNA, 66 nt, Homo Sapiens
ugauagaauaggaaaauuuuaacauuuuuguuucuaaggauaguuuuaauuuucuuauuuuuuuca

SEQ ID NO: 7635 - RNA, 24 nt, Homo Sapiens
uagaauaggaaaauuuuaacauuu

SEQ ID NO: 7636 - RNA, 18 nt, Homo Sapiens
uagaagcaaaauuuuaac

SEQ ID NO: 7637 - RNA, 62 nt, Homo Sapiens
ugaucuccugugggucuggugcuauauucuagagaaguuugcaccuggacaauaggaauucg

SEQ ID NO: 7638 - RNA, 24 nt, Homo Sapiens
ucuccugugggucuggugcuauau

SEQ ID NO: 7639 - RNA, 18 nt, Homo Sapiens
ccuguggguccuggcuau

SEQ ID NO: 7640 - RNA, 20 nt, Homo Sapiens
ccucugggucuggagaaaua

SEQ ID NO: 7641 - RNA, 22 nt, Homo Sapiens
cucccaugugggucuggggaua

SEQ ID NO: 7642 - RNA, 20 nt, Homo Sapiens
cuccgugggucuguguguau

SEQ ID NO: 7643 - RNA, 23 nt, Homo Sapiens
cugugggucauggugcaugauau

SEQ ID NO: 7644 - RNA, 21 nt, Homo Sapiens
uccugugggguucauuggugc

SEQ ID NO: 7645 - RNA, 19 nt, Homo Sapiens
uccugugggcacuggggcu

SEQ ID NO: 7646 - RNA, 20 nt, Homo Sapiens
uccuuuggguccuggugcua

SEQ ID NO: 7647 - RNA, 20 nt, Homo Sapiens
ucuccuguguuucucgggcu

SEQ ID NO: 7648 - RNA, 19 nt, Homo Sapiens
ugugggucuggcugcuuau

SEQ ID NO: 7649 - RNA, 65 nt, Homo Sapiens
ugaucuggaagccaaccuggcuguccugaagcuguaccaguucaacccagccuucuuucagacca

SEQ ID NO: 7650 - RNA, 24 nt, Homo Sapiens
uggaagccaaccuggcuguccuga

SEQ ID NO: 7651 - RNA, 22 nt, Homo Sapiens
agacaaccugcuggcugucuug

SEQ ID NO: 7652 - RNA, 20 nt, Homo Sapiens
agccaacaucacuguccuga

SEQ ID NO: 7653 - RNA, 19 nt, Homo Sapiens
gccagcaccugcuguccug

SEQ ID NO: 7654 - RNA, 20 nt, Homo Sapiens
gccacaccuggcugcugcug

SEQ ID NO: 7655 - RNA, 19 nt, Homo Sapiens
gccaaccugagcuacccug

SEQ ID NO: 7656 - RNA, 19 nt, Homo Sapiens
gccaaccugggcauacuga

SEQ ID NO: 7657 - RNA, 23 nt, Homo Sapiens
ggagggcaguccuggcugucgug

SEQ ID NO: 7658 - RNA, 22 nt, Homo Sapiens
gggagccagccaaggcuguccu

SEQ ID NO: 7659 - RNA, 16 nt, Homo Sapiens
ggcagccaaccuuguc

SEQ ID NO: 7660 - RNA, 17 nt, Homo Sapiens
ggaagcccuggcugucc

SEQ ID NO: 7661 - RNA, 20 nt, Homo Sapiens
ggaggccaaccuguucuccu

SEQ ID NO: 7662 - RNA, 22 nt, Homo Sapiens
uggaagccagggcuggcugccc

SEQ ID NO: 7663 - RNA, 26 nt, Homo Sapiens
ugaaagacaggcucuggcugucauga

SEQ ID NO: 7664 - RNA, 17 nt, Homo Sapiens
ugaaagcaccuggcugu

SEQ ID NO: 7665 - RNA, 21 nt, Homo Sapiens
uggaagccacucucucuuccu

SEQ ID NO: 7666 - RNA, 22 nt, Homo Sapiens
uggaagccacccaggagucuga

SEQ ID NO: 7667 - RNA, 72 nt, Homo Sapiens
ugaugaaaugcacuuucccgugcagcaguguucuuuugccugucaacugcugggugguuuuugcauucauca

SEQ ID NO: 7668 - RNA, 24 nt, Homo Sapiens
ugaaaugcacuuucccgugcagca

SEQ ID NO: 7669 - RNA, 18 nt, Homo Sapiens
aaaagcacuuuccuggca

SEQ ID NO: 7670 - RNA, 20 nt, Homo Sapiens
aaaugcacuuucacgaggag

SEQ ID NO: 7671 - RNA, 22 nt, Homo Sapiens
aaugcacuuuucaucaugcagc

SEQ ID NO: 7672 - RNA, 19 nt, Homo Sapiens
augcacuuuucaugcagca

SEQ ID NO: 7673 - RNA, 22 nt, Homo Sapiens
gaagauucaguacccgugcagc

SEQ ID NO: 7674 - RNA, 25 nt, Homo Sapiens
gaaaugcacuuauuuccuuuccagc

SEQ ID NO: 7675 - RNA, 21 nt, Homo Sapiens
ugaaaugcacacuccagagca

SEQ ID NO: 7676 - RNA, 23 nt, Homo Sapiens
uguaacgcacuuucccuacagca

SEQ ID NO: 7677 - RNA, 60 nt, Homo Sapiens
ugaugagaacaccguguacagcaucggcgaggacgggaagguaggcggcugcaggauuca

SEQ ID NO: 7678 - RNA, 24 nt, Homo Sapiens
ugagaacaccguguacagcaucgg

SEQ ID NO: 7679 - RNA, 18 nt, Homo Sapiens
agagccccuguacagcau

SEQ ID NO: 7680 - RNA, 20 nt, Homo Sapiens
gagaacaccaucuaguacag

SEQ ID NO: 7681 - RNA, 18 nt, Homo Sapiens
gagaacaccuggacaaca

SEQ ID NO: 7682 - RNA, 16 nt, Homo Sapiens
gaguacauguacagca

SEQ ID NO: 7683 - RNA, 23 nt, Homo Sapiens
gagaaccacaaguacagcauggg

SEQ ID NO: 7684 - RNA, 24 nt, Homo Sapiens
ugaggcacgcugggucagcaucgg

SEQ ID NO: 7685 - RNA, 21 nt, Homo Sapiens
ugagaacacgcaguauucagc

SEQ ID NO: 7686 - RNA, 21 nt, Homo Sapiens
ugagaacaccagacguacagc

SEQ ID NO: 7687 - RNA, 20 nt, Homo Sapiens
ugagaacacuguccagagca

SEQ ID NO: 7688 - RNA, 18 nt, Homo Sapiens
ugagaacaccacagccuc

SEQ ID NO: 7689 - RNA, 61 nt, Homo Sapiens
ugauggugcuugugccgcuccuuguggcccuuaugcuugggcccggccgcgcucaccguca

SEQ ID NO: 7690 - RNA, 24 nt, Homo Sapiens
uggugcuugugccgcuccuugugg

SEQ ID NO: 7691 - RNA, 22 nt, Homo Sapiens
cuugcugccgcucccgcugugg

SEQ ID NO: 7692 - RNA, 21 nt, Homo Sapiens
cuugugccguuguccuugggg

SEQ ID NO: 7693 - RNA, 24 nt, Homo Sapiens
gugcuugugaccaugcucacaugu

SEQ ID NO: 7694 - RNA, 20 nt, Homo Sapiens
gugcagggccagcuccuugu

SEQ ID NO: 7695 - RNA, 27 nt, Homo Sapiens
ugcuccugugcuccgcucuccuugugg

SEQ ID NO: 7696 - RNA, 21 nt, Homo Sapiens
ugcgcgugucgucuccuugug

SEQ ID NO: 7697 - RNA, 25 nt, Homo Sapiens
uggugcuuguaaucccagcuacuug

SEQ ID NO: 7698 - RNA, 21 nt, Homo Sapiens
uguugcucggagccgcuccuu

SEQ ID NO: 7699 - RNA, 25 nt, Homo Sapiens
uggugcuugcgggcugcuccuugug

SEQ ID NO: 7700 - RNA, 19 nt, Homo Sapiens
ugaugccccugccgcuccu

SEQ ID NO: 7701 - RNA, 19 nt, Homo Sapiens
uggugcuuggggcgugccu

SEQ ID NO: 7702 - RNA, 17 nt, Homo Sapiens
uggugcuugugccuccu

SEQ ID NO: 7703 - RNA, 21 nt, Homo Sapiens
uggaacuugucagcuccuugu

SEQ ID NO: 7704 - RNA, 84 nt, Homo Sapiens
ugcacuggcaccuagacauguacaacaggaaccguguggauacaucccccacaccuguuucuguggcauggucauguguaugca

SEQ ID NO: 7705 - RNA, 24 nt, Homo Sapiens
agacauguacaacaggaaccgugu

SEQ ID NO: 7706 - RNA, 23 nt, Homo Sapiens
acaugaacacaugacaggaaccg

SEQ ID NO: 7707 - RNA, 21 nt, Homo Sapiens
acauguacacagacacugugu

SEQ ID NO: 7708 - RNA, 18 nt, Homo Sapiens
acauguacaaaacugugu

SEQ ID NO: 7709 - RNA, 21 nt, Homo Sapiens
agacuguguacaacagugaac

SEQ ID NO: 7710 - RNA, 20 nt, Homo Sapiens
agaaugcauacaacaggaac

SEQ ID NO: 7711 - RNA, 27 nt, Homo Sapiens
agacauguacacacagaugaauacgug

SEQ ID NO: 7712 - RNA, 17 nt, Homo Sapiens
agacgucaacaggaacc

SEQ ID NO: 7713 - RNA, 16 nt, Homo Sapiens
agacuguacaggaacc

SEQ ID NO: 7714 - RNA, 20 nt, Homo Sapiens
agaaacggaaacaggaaccg

SEQ ID NO: 7715 - RNA, 20 nt, Homo Sapiens
aggcaugcaaaaggaaccgu

SEQ ID NO: 7716 - RNA, 19 nt, Homo Sapiens
agacuugucaggaaccgug

SEQ ID NO: 7717 - RNA, 21 nt, Homo Sapiens
agacagaccaacaggaagugu

SEQ ID NO: 7718 - RNA, 21 nt, Homo Sapiens
gacauguaccuaacagaagcg

SEQ ID NO: 7719 - RNA, 69 nt, Homo Sapiens
ugcagaugacaccagguucaggaaagaggaugucuacaguugcuuucgcuuccuacgugguguuuugca

SEQ ID NO: 7720 - RNA, 24 nt, Homo Sapiens
ugacaccagguucaggaaagagga

SEQ ID NO: 7721 - RNA, 20 nt, Homo Sapiens
acaccaggugccaggcaaag

SEQ ID NO: 7722 - RNA, 20 nt, Homo Sapiens
acaacagcucaaggaaagag

SEQ ID NO: 7723 - RNA, 22 nt, Homo Sapiens
accccaccuacaggaaagaaga

SEQ ID NO: 7724 - RNA, 22 nt, Homo Sapiens
cacacaggcaggggaaagagga

SEQ ID NO: 7725 - RNA, 18 nt, Homo Sapiens
caacagccggaaagagga

SEQ ID NO: 7726 - RNA, 21 nt, Homo Sapiens
ccagguucaugaacacagagg

SEQ ID NO: 7727 - RNA, 18 nt, Homo Sapiens
ccagaucgggaaagagga

SEQ ID NO: 7728 - RNA, 21 nt, Homo Sapiens
gacuaccgggugaggaaagag

SEQ ID NO: 7729 - RNA, 18 nt, Homo Sapiens
gacauccaguucaggaaa

SEQ ID NO: 7730 - RNA, 20 nt, Homo Sapiens
gacaccagggagagggaaga

SEQ ID NO: 7731 - RNA, 17 nt, Homo Sapiens
gacaucaucaggaaaga

SEQ ID NO: 7732 - RNA, 19 nt, Homo Sapiens
gacaccaggccagaagagg

SEQ ID NO: 7733 - RNA, 19 nt, Homo Sapiens
ugacaggccugguucagga

SEQ ID NO: 7734 - RNA, 18 nt, Homo Sapiens
ugacccaauuucaggaaa

SEQ ID NO: 7735 - RNA, 20 nt, Homo Sapiens
ugaagcaggaggaaagagga

SEQ ID NO: 7736 - RNA, 70 nt, Homo Sapiens
ugcaugagguuugguaacaggcaaagucaucugguuaacgugacugaugcaaaaaguccaggccugggca

SEQ ID NO: 7737 - RNA, 24 nt, Homo Sapiens
ugagguuugguaacaggcaaaguc

SEQ ID NO: 7738 - RNA, 21 nt, Homo Sapiens
agguucaggucccaggcaaag

SEQ ID NO: 7739 - RNA, 21 nt, Homo Sapiens
agguuuggugaacuggggaag

SEQ ID NO: 7740 - RNA, 24 nt, Homo Sapiens
agguuuggugucaugggcucaguc

SEQ ID NO: 7741 - RNA, 20 nt, Homo Sapiens
aggaugcggaacaggcaaag

SEQ ID NO: 7742 - RNA, 21 nt, Homo Sapiens
gguuugauuggaacaggcaaa

SEQ ID NO: 7743 - RNA, 19 nt, Homo Sapiens
ggguggguaacaggcacag

SEQ ID NO: 7744 - RNA, 20 nt, Homo Sapiens
ggugggguaugaggcaaagu

SEQ ID NO: 7745 - RNA, 18 nt, Homo Sapiens
guuugcaaaaggcaaagu

SEQ ID NO: 7746 - RNA, 19 nt, Homo Sapiens
ugagguuugcugaaagcca

SEQ ID NO: 7747 - RNA, 20 nt, Homo Sapiens
ugagauuugguaacagcaaa

SEQ ID NO: 7748 - RNA, 24 nt, Homo Sapiens
ugaggcaggagaagaggcaaaguc

SEQ ID NO: 7749 - RNA, 19 nt, Homo Sapiens
ugagguuugggaaaaaguc

SEQ ID NO: 7750 - RNA, 20 nt, Homo Sapiens
uuugguaacauacauuaagu

SEQ ID NO: 7751 - RNA, 19 nt, Homo Sapiens
uuggggaccuggcaaaguc

SEQ ID NO: 7752 - RNA, 19 nt, Homo Sapiens
uuuuuuaaauggcaaaguc

SEQ ID NO: 7753 - RNA, 131 nt, Homo Sapiens
ugccaggcauaaucaacauuccucauuacuucuucaacauccucuugaaagcugugcucauuuuacaaaugagaaaacagauuuagagaaauauaaugacuuguaugaggucacauagcuuaugaguggca

SEQ ID NO: 7754 - RNA, 24 nt, Homo Sapiens
ugagaaaacagauuuagagaaaua

SEQ ID NO: 7755 - RNA, 20 nt, Homo Sapiens
aaaacagaucuagagacaau

SEQ ID NO: 7756 - RNA, 19 nt, Homo Sapiens
aaaacagauucauaaaaau

SEQ ID NO: 7757 - RNA, 24 nt, Homo Sapiens
agauaaacaaaauguagagaaaua

SEQ ID NO: 7758 - RNA, 20 nt, Homo Sapiens
agaaaaaaugauuagagaaa

SEQ ID NO: 7759 - RNA, 20 nt, Homo Sapiens
agaaaaaaugauuagagaaa

SEQ ID NO: 7760 - RNA, 24 nt, Homo Sapiens
agaaaacaguccacuuaaagaaau

SEQ ID NO: 7761 - RNA, 23 nt, Homo Sapiens
agaaaacagaguucauagagaaa

SEQ ID NO: 7762 - RNA, 21 nt, Homo Sapiens
agaaaacagacuaagccagaa

SEQ ID NO: 7763 - RNA, 16 nt, Homo Sapiens
agaaaacaguagagaa

SEQ ID NO: 7764 - RNA, 19 nt, Homo Sapiens
agaaagcaguuuuagagaa

SEQ ID NO: 7765 - RNA, 20 nt, Homo Sapiens
aguaaucauauuuagagaaa

SEQ ID NO: 7766 - RNA, 21 nt, Homo Sapiens
agaaaacagaaucagaggaau

SEQ ID NO: 7767 - RNA, 21 nt, Homo Sapiens
gaaaccuagauuuagaaaaau

SEQ ID NO: 7768 - RNA, 18 nt, Homo Sapiens
gaaaacagauuugaaaaa

SEQ ID NO: 7769 - RNA, 21 nt, Homo Sapiens
gagauaaacagauuacagaaa

SEQ ID NO: 7770 - RNA, 26 nt, Homo Sapiens
gagaaaaagaaccagauuuagaaaaa

SEQ ID NO: 7771 - RNA, 20 nt, Homo Sapiens
gagaacacagggauuuagag

SEQ ID NO: 7772 - RNA, 25 nt, Homo Sapiens
ugaaaaaaguacagauuuacaaaau

SEQ ID NO: 7773 - RNA, 26 nt, Homo Sapiens
ugugaacacaggguuuuagagaagua

SEQ ID NO: 7774 - RNA, 21 nt, Homo Sapiens
ugggauaacagauuugagaga

SEQ ID NO: 7775 - RNA, 20 nt, Homo Sapiens
ugagaauucccauuuagaga

SEQ ID NO: 7776 - RNA, 19 nt, Homo Sapiens
ugaggaagcauuuagagaa

SEQ ID NO: 7777 - RNA, 22 nt, Homo Sapiens
ugagaaaacauauuuaauaaau

SEQ ID NO: 7778 - RNA, 79 nt, Homo Sapiens
ugccccuuccaugaccagccacaucugaaaaggaaagcauucugcucuuuccagaucuacgcugugccuuggcagggca

SEQ ID NO: 7779 - RNA, 24 nt, Homo Sapiens
ugaccagccacaucugaaaaggaa

SEQ ID NO: 7780 - RNA, 19 nt, Homo Sapiens
accagccacacaaaaaagg

SEQ ID NO: 7781 - RNA, 21 nt, Homo Sapiens
accagccaagaagaaaaggaa

SEQ ID NO: 7782 - RNA, 19 nt, Homo Sapiens
agcucacuucugaaaagga

SEQ ID NO: 7783 - RNA, 19 nt, Homo Sapiens
cagccacauuccugaagag

SEQ ID NO: 7784 - RNA, 22 nt, Homo Sapiens
cagcacauacucggaaaaggaa

SEQ ID NO: 7785 - RNA, 18 nt, Homo Sapiens
caggcacugugaaaagga

SEQ ID NO: 7786 - RNA, 20 nt, Homo Sapiens
ccccaucuccugaaaaggaa

SEQ ID NO: 7787 - RNA, 19 nt, Homo Sapiens
ccacaucugcaaaaaagaa

SEQ ID NO: 7788 - RNA, 21 nt, Homo Sapiens
ccacgacaucccugaaaagga

SEQ ID NO: 7789 - RNA, 16 nt, Homo Sapiens
ccagccacagaaaagg

SEQ ID NO: 7790 - RNA, 19 nt, Homo Sapiens
ccagccacaugcagaggaa

SEQ ID NO: 7791 - RNA, 23 nt, Homo Sapiens
gaccaugccaccuucugaaaagg

SEQ ID NO: 7792 - RNA, 20 nt, Homo Sapiens
gaccaagccacaucugaaaa

SEQ ID NO: 7793 - RNA, 24 nt, Homo Sapiens
gaccagccaagcaacagaauaagg

SEQ ID NO: 7794 - RNA, 23 nt, Homo Sapiens
gaacauccacgauggaaaaggaa

SEQ ID NO: 7795 - RNA, 20 nt, Homo Sapiens
gacuagcacuacugaaaagg

SEQ ID NO: 7796 - RNA, 19 nt, Homo Sapiens
ugaccuuagucacaucuga

SEQ ID NO: 7797 - RNA, 28 nt, Homo Sapiens
ugaccacagaacaacagaugaaaaggaa

SEQ ID NO: 7798 - RNA, 21 nt, Homo Sapiens
ugcccaagccacaucucauaa

SEQ ID NO: 7799 - RNA, 22 nt, Homo Sapiens
ugaccagccgacguuuuuaaag

SEQ ID NO: 7800 - RNA, 18 nt, Homo Sapiens
ugaccagccucacaaaag

SEQ ID NO: 7801 - RNA, 21 nt, Homo Sapiens
ugaccagccccacugggaagg

SEQ ID NO: 7802 - RNA, 23 nt, Homo Sapiens
ugaccagccagucaauaacggaa

SEQ ID NO: 7803 - RNA, 71 nt, Homo Sapiens
ugcccgcguacaugggcugaggaauguucaagcagaagaaaugguagaguuuucuucaggcuuaaagggua

SEQ ID NO: 7804 - RNA, 24 nt, Homo Sapiens
aaugguagaguuuucuucaggcuu

SEQ ID NO: 7805 - RNA, 19 nt, Homo Sapiens
aaugguagauguuguguuc

SEQ ID NO: 7806 - RNA, 22 nt, Homo Sapiens
aaugguagagaaugcucuuuag

SEQ ID NO: 7807 - RNA, 18 nt, Homo Sapiens
aauguuguguuuucuuca

SEQ ID NO: 7808 - RNA, 16 nt, Homo Sapiens
aauguuauuuucuuca

SEQ ID NO: 7809 - RNA, 18 nt, Homo Sapiens
aaugguagaaccuucagg

SEQ ID NO: 7810 - RNA, 20 nt, Homo Sapiens
agagucucgcucuucaggcu

SEQ ID NO: 7811 - RNA, 19 nt, Homo Sapiens
auggauugaguuuucucag

SEQ ID NO: 7812 - RNA, 23 nt, Homo Sapiens
auggcaguuacuguucuucaggc

SEQ ID NO: 7813 - RNA, 18 nt, Homo Sapiens
augggaguuuucugucag

SEQ ID NO: 7814 - RNA, 17 nt, Homo Sapiens
augguagagauguucag

SEQ ID NO: 7815 - RNA, 20 nt, Homo Sapiens
gggagaauucccuucaggcu

SEQ ID NO: 7816 - RNA, 16 nt, Homo Sapiens
uacaguuuucuugcuu

SEQ ID NO: 7817 - RNA, 24 nt, Homo Sapiens
ugguacagguuucacucuucaggc

SEQ ID NO: 7818 - RNA, 23 nt, Homo Sapiens
ugguagagucuguugcagugcuu

SEQ ID NO: 7819 - RNA, 19 nt, Homo Sapiens
ugguagaguuucaggucuu

SEQ ID NO: 7820 - RNA, 20 nt, Homo Sapiens
ugggaaagccuucuucaggc

SEQ ID NO: 7821 - RNA, 60 nt, Homo Sapiens
ugccgacucuaucgaucccuuaccuucaaugagaccuaccaggacaucagugaguuggua

SEQ ID NO: 7822 - RNA, 24 nt, Homo Sapiens
uaccaggacaucagugaguuggua

SEQ ID NO: 7823 - RNA, 19 nt, Homo Sapiens
accaggacaaucugugugu

SEQ ID NO: 7824 - RNA, 22 nt, Homo Sapiens
accaggacagccagcugagcug

SEQ ID NO: 7825 - RNA, 18 nt, Homo Sapiens
accaggacacaguguguu

SEQ ID NO: 7826 - RNA, 18 nt, Homo Sapiens
aggagcacagugaguugg

SEQ ID NO: 7827 - RNA, 20 nt, Homo Sapiens
agcacugcagugaguuguua

SEQ ID NO: 7828 - RNA, 20 nt, Homo Sapiens
cagcacugaacagugaguug

SEQ ID NO: 7829 - RNA, 21 nt, Homo Sapiens
caggacaucugagugaguggg

SEQ ID NO: 7830 - RNA, 20 nt, Homo Sapiens
gacuucaagggugaguuggu

SEQ ID NO: 7831 - RNA, 18 nt, Homo Sapiens
ggaauccaugaguuggua

SEQ ID NO: 7832 - RNA, 19 nt, Homo Sapiens
ggacaucagcaaacuggua

SEQ ID NO: 7833 - RNA, 27 nt, Homo Sapiens
uaccaggacauccaggauugccuuggu

SEQ ID NO: 7834 - RNA, 19 nt, Homo Sapiens
uaccaggacagcacuagag

SEQ ID NO: 7835 - RNA, 62 nt, Homo Sapiens
ugccucugcuuucauuucuaugguuauucguggaaugacucauugaccacgcggagaaggca

SEQ ID NO: 7836 - RNA, 24 nt, Homo Sapiens
gacucauugaccacgcggagaagg

SEQ ID NO: 7837 - RNA, 21 nt, Homo Sapiens
caugugacuccccggagaagg

SEQ ID NO: 7838 - RNA, 23 nt, Homo Sapiens
gacuccaguuugaccacgggcag

SEQ ID NO: 7839 - RNA, 67 nt, Homo Sapiens
ugccuggaauggcagcaucuacauguucaacuggcacccagugcuuaugguugcuggcaugguggua

SEQ ID NO: 7840 - RNA, 24 nt, Homo Sapiens
uggcagcaucuacauguucaacug

SEQ ID NO: 7841 - RNA, 19 nt, Homo Sapiens
agcaucuacauuuuaagug

SEQ ID NO: 7842 - RNA, 18 nt, Homo Sapiens
cagcaucuaacaguucaa

SEQ ID NO: 7843 - RNA, 20 nt, Homo Sapiens
cagcaucuaaugcuucacug

SEQ ID NO: 7844 - RNA, 20 nt, Homo Sapiens
caguaucuacauguaucuac

SEQ ID NO: 7845 - RNA, 19 nt, Homo Sapiens
cagcauucauguucaaaug

SEQ ID NO: 7846 - RNA, 20 nt, Homo Sapiens
gcaacauacauacauguuca

SEQ ID NO: 7847 - RNA, 18 nt, Homo Sapiens
gcaacaggucauguucaa

SEQ ID NO: 7848 - RNA, 20 nt, Homo Sapiens
gcagcaucucugaucagcug

SEQ ID NO: 7849 - RNA, 17 nt, Homo Sapiens
ggcaacauacauguuca

SEQ ID NO: 7850 - RNA, 19 nt, Homo Sapiens
ggcagcaucuucaagugca

SEQ ID NO: 7851 - RNA, 21 nt, Homo Sapiens
ggcagcaucuccaggucagcu

SEQ ID NO: 7852 - RNA, 22 nt, Homo Sapiens
uggcugcauuagucuacauguu

SEQ ID NO: 7853 - RNA, 20 nt, Homo Sapiens
uggcagcaucaacagcuuca

SEQ ID NO: 7854 - RNA, 20 nt, Homo Sapiens
uggcagcauggacuuguuca

SEQ ID NO: 7855 - RNA, 19 nt, Homo Sapiens
ugggggcaucuacauuuca

SEQ ID NO: 7856 - RNA, 22 nt, Homo Sapiens
ugacaguauuuacauguuccac

SEQ ID NO: 7857 - RNA, 22 nt, Homo Sapiens
uggcaccauccgguguucaacu

SEQ ID NO: 7858 - RNA, 81 nt, Homo Sapiens
ugcggccgauggcgggcugcgggcaagcgucacccugcugggugccgggcugcugcugagccugcugccggcccugcugcg

SEQ ID NO: 7859 - RNA, 24 nt, Homo Sapiens
uggcgggcugcgggcaagcgucac

SEQ ID NO: 7860 - RNA, 20 nt, Homo Sapiens
gcuggcuggcuggcaagcgu

SEQ ID NO: 7861 - RNA, 20 nt, Homo Sapiens
gcgggcugccagggccaagc

SEQ ID NO: 7862 - RNA, 22 nt, Homo Sapiens
ggcugggcugcggagcgugcac

SEQ ID NO: 7863 - RNA, 19 nt, Homo Sapiens
ggcggggcaggcgggcaag

SEQ ID NO: 7864 - RNA, 21 nt, Homo Sapiens
ggcgggcugcugagcauccgu

SEQ ID NO: 7865 - RNA, 25 nt, Homo Sapiens
ggcaggcugcgggccacagggacac

SEQ ID NO: 7866 - RNA, 19 nt, Homo Sapiens
ggcgggcugcgcgcccgcg

SEQ ID NO: 7867 - RNA, 21 nt, Homo Sapiens
ggcgggcugaggcaugagcca

SEQ ID NO: 7868 - RNA, 22 nt, Homo Sapiens
ggcguccugcgggcagagacac

SEQ ID NO: 7869 - RNA, 19 nt, Homo Sapiens
ggcuggcgggcaaggccac

SEQ ID NO: 7870 - RNA, 19 nt, Homo Sapiens
gggcggucgugcaagcguc

SEQ ID NO: 7871 - RNA, 19 nt, Homo Sapiens
gggcugcggggagacuuca

SEQ ID NO: 7872 - RNA, 20 nt, Homo Sapiens
gggauacaggcaagcgucac

SEQ ID NO: 7873 - RNA, 22 nt, Homo Sapiens
uggcgggcugcacggugcacgc

SEQ ID NO: 7874 - RNA, 19 nt, Homo Sapiens
uggccugcugcgggccaag

SEQ ID NO: 7875 - RNA, 21 nt, Homo Sapiens
uggaaggcugcggggaggguc

SEQ ID NO: 7876 - RNA, 65 nt, Homo Sapiens
ugcucacagggugugacuggcccacuaucuaggguagugagccuauuuuguggccccugugugca

SEQ ID NO: 7877 - RNA, 24 nt, Homo Sapiens
ucacagggugugacuggcccacua

SEQ ID NO: 7878 - RNA, 22 nt, Homo Sapiens
cacagaggagggaugacuggcc

SEQ ID NO: 7879 - RNA, 19 nt, Homo Sapiens
cagagggugugagugaccc

SEQ ID NO: 7880 - RNA, 18 nt, Homo Sapiens
cagagggugugaugccca

SEQ ID NO: 7881 - RNA, 21 nt, Homo Sapiens
caccgggugugacucggcuac

SEQ ID NO: 7882 - RNA, 21 nt, Homo Sapiens
cagagggcaaggcuggcccac

SEQ ID NO: 7883 - RNA, 22 nt, Homo Sapiens
cagugugagaacacuggcccac

SEQ ID NO: 7884 - RNA, 18 nt, Homo Sapiens
cagggugugguggcacac

SEQ ID NO: 7885 - RNA, 24 nt, Homo Sapiens
ucacaggguuggcuugggcaccac

SEQ ID NO: 7886 - RNA, 22 nt, Homo Sapiens
ucccagggugugcgucacccac

SEQ ID NO: 7887 - RNA, 21 nt, Homo Sapiens
ucacagggucacugccccucu

SEQ ID NO: 7888 - RNA, 24 nt, Homo Sapiens
ucacagggugagaauggucaagua

SEQ ID NO: 7889 - RNA, 24 nt, Homo Sapiens
ucucagggcagcccuggcccacua

SEQ ID NO: 7890 - RNA, 89 nt, Homo Sapiens
ugcucccgaccaucaccugugggcacaccaucgagauccuccgggagaagggcuucgaccaggcgcccgugguggaugaggcgggggua

SEQ ID NO: 7891 - RNA, 24 nt, Homo Sapiens
ucaccugugggcacaccaucgaga

SEQ ID NO: 7892 - RNA, 21 nt, Homo Sapiens
cagcugugggcaacaacucga

SEQ ID NO: 7893 - RNA, 23 nt, Homo Sapiens
caccugugggcaaggcacuagcg

SEQ ID NO: 7894 - RNA, 19 nt, Homo Sapiens
ccugugggcauucaacauc

SEQ ID NO: 7895 - RNA, 18 nt, Homo Sapiens
ucacugugggcagcgcca

SEQ ID NO: 7896 - RNA, 64 nt, Homo Sapiens
ugcuggcaugcuagguuucuggguucucucucccugagcgguccuggugacccugcuugaagca

SEQ ID NO: 7897 - RNA, 24 nt, Homo Sapiens
uggcaugcuagguuucuggguucu

SEQ ID NO: 7898 - RNA, 20 nt, Homo Sapiens
caugccauacauuucugggu

SEQ ID NO: 7899 - RNA, 22 nt, Homo Sapiens
caugcuuugugcuuucuggguu

SEQ ID NO: 7900 - RNA, 20 nt, Homo Sapiens
cuaggguugcucuggguucu

SEQ ID NO: 7901 - RNA, 23 nt, Homo Sapiens
gcauacucggauugcuggguucu

SEQ ID NO: 7902 - RNA, 21 nt, Homo Sapiens
gcaugcuagagcugguguucu

SEQ ID NO: 7903 - RNA, 20 nt, Homo Sapiens
ggcaguacuagguuucaggg

SEQ ID NO: 7904 - RNA, 21 nt, Homo Sapiens
ggcauggugcuagguuccagg

SEQ ID NO: 7905 - RNA, 18 nt, Homo Sapiens
ggcuucuggguuucuggg

SEQ ID NO: 7906 - RNA, 22 nt, Homo Sapiens
ggcagauucgguuucugguuuc

SEQ ID NO: 7907 - RNA, 22 nt, Homo Sapiens
ggcuccuggguugcuggguucu

SEQ ID NO: 7908 - RNA, 19 nt, Homo Sapiens
uggcaugggacuggguucu

SEQ ID NO: 7909 - RNA, 61 nt, Homo Sapiens
ugcugggaauaccauagccaccuuuuagggaaacuuaaauuauguuuuuggauacccugua

SEQ ID NO: 7910 - RNA, 24 nt, Homo Sapiens
ugggaauaccauagccaccuuuua

SEQ ID NO: 7911 - RNA, 20 nt, Homo Sapiens
aauaacacauagccacccuu

SEQ ID NO: 7912 - RNA, 25 nt, Homo Sapiens
gggaauaccacuuccacuuucuuuu

SEQ ID NO: 7913 - RNA, 22 nt, Homo Sapiens
gggaaacugucgccaccuuuua

SEQ ID NO: 7914 - RNA, 20 nt, Homo Sapiens
uggcaaguagcauagccacc

SEQ ID NO: 7915 - RNA, 25 nt, Homo Sapiens
ugggauuaaaggcaugagccaccuu

SEQ ID NO: 7916 - RNA, 23 nt, Homo Sapiens
ugggaauacaggcacaugccacc

SEQ ID NO: 7917 - RNA, 21 nt, Homo Sapiens
ugggagggucagagccaccuu

SEQ ID NO: 7918 - RNA, 69 nt, Homo Sapiens
uggaguaccuucuacugccucagugggcaaauccaaaaccccauuaguggcaaggaagaaaguguuccg

SEQ ID NO: 7919 - RNA, 24 nt, Homo Sapiens
uuaguggcaaggaagaaaguguuc

SEQ ID NO: 7920 - RNA, 20 nt, Homo Sapiens
aguggauggaaaagaaagug

SEQ ID NO: 7921 - RNA, 19 nt, Homo Sapiens
guggcaaggaucaaggaag

SEQ ID NO: 7922 - RNA, 21 nt, Homo Sapiens
ugguaaugaaagaaagugguc

SEQ ID NO: 7923 - RNA, 19 nt, Homo Sapiens
uuaugucagaagaaagugu

SEQ ID NO: 7924 - RNA, 69 nt, Homo Sapiens
uggauaacaguauaauagcauuuacaauauuucacucuuuguucucuuaaugucuuauauaguuauuua

SEQ ID NO: 7925 - RNA, 24 nt, Homo Sapiens
uaacaguauaauagcauuuacaau

SEQ ID NO: 7926 - RNA, 26 nt, Homo Sapiens
aaaagugaauacauagcauuucaaau

SEQ ID NO: 7927 - RNA, 23 nt, Homo Sapiens
aacaguaauaauagcaucuaaau

SEQ ID NO: 7928 - RNA, 23 nt, Homo Sapiens
aacauuagacaaaacauuuacaa

SEQ ID NO: 7929 - RNA, 19 nt, Homo Sapiens
aacaguauaaauguuuaca

SEQ ID NO: 7930 - RNA, 22 nt, Homo Sapiens
aauauuuuauuggcauuuacaa

SEQ ID NO: 7931 - RNA, 21 nt, Homo Sapiens
aacaguauaaaacauuacuau

SEQ ID NO: 7932 - RNA, 22 nt, Homo Sapiens
acaguauaauaucacacuuaca

SEQ ID NO: 7933 - RNA, 21 nt, Homo Sapiens
acaguauaaaagcguuauuua

SEQ ID NO: 7934 - RNA, 19 nt, Homo Sapiens
acaguauaacagcucuuua

SEQ ID NO: 7935 - RNA, 23 nt, Homo Sapiens
acauaauuauagcauuuaccaau

SEQ ID NO: 7936 - RNA, 20 nt, Homo Sapiens
acaguauaacaacgauuaca

SEQ ID NO: 7937 - RNA, 19 nt, Homo Sapiens
acaauauaggcauuuacaa

SEQ ID NO: 7938 - RNA, 22 nt, Homo Sapiens
acaguauuacuucauuuacaau

SEQ ID NO: 7939 - RNA, 22 nt, Homo Sapiens
acauuguaauagcaucuuuaau

SEQ ID NO: 7940 - RNA, 18 nt, Homo Sapiens
aguugacagcauuuacaa

SEQ ID NO: 7941 - RNA, 25 nt, Homo Sapiens
uaacaacgauuacauagcauuuaca

SEQ ID NO: 7942 - RNA, 28 nt, Homo Sapiens
uaacauucaaaauaccaauauuuacaau

SEQ ID NO: 7943 - RNA, 24 nt, Homo Sapiens
uaaccauaaaugagcauuuacaau

SEQ ID NO: 7944 - RNA, 21 nt, Homo Sapiens
uaaaauaugguaagcauuuac

SEQ ID NO: 7945 - RNA, 22 nt, Homo Sapiens
uaacaguauaaaaguuguuuac

SEQ ID NO: 7946 - RNA, 18 nt, Homo Sapiens
uaaauuaaaauagcauuu

SEQ ID NO: 7947 - RNA, 22 nt, Homo Sapiens
uaaaaguuucauugcauuuaca

SEQ ID NO: 7948 - RNA, 22 nt, Homo Sapiens
uaacaguauauaaacauaaaca

SEQ ID NO: 7949 - RNA, 20 nt, Homo Sapiens
uaacagcacaacauuuacaa

SEQ ID NO: 7950 - RNA, 24 nt, Homo Sapiens
uaacaauacuugaacauuuacaau

SEQ ID NO: 7951 - RNA, 21 nt, Homo Sapiens
uauaaaaccagcauuuacaau

SEQ ID NO: 7952 - RNA, 77 nt, Homo Sapiens
uggauuccggaugacacacacagucaccaccaucaguuaccugaaccuggccguggcugacuucuguuucaccucca

SEQ ID NO: 7953 - RNA, 24 nt, Homo Sapiens
ugacacacacagucaccaccauca

SEQ ID NO: 7954 - RNA, 22 nt, Homo Sapiens
acccaucacauuuaccaccauc

SEQ ID NO: 7955 - RNA, 23 nt, Homo Sapiens
acacacacacccugucaccaaca

SEQ ID NO: 7956 - RNA, 19 nt, Homo Sapiens
acacacacaguuacaccac

SEQ ID NO: 7957 - RNA, 25 nt, Homo Sapiens
acacacacacacacacucacacauc

SEQ ID NO: 7958 - RNA, 22 nt, Homo Sapiens
acacacacacacacaugcacca

SEQ ID NO: 7959 - RNA, 23 nt, Homo Sapiens
acacacacaccacccgcgccauc

SEQ ID NO: 7960 - RNA, 25 nt, Homo Sapiens
acacacacagacacuguaaacauca

SEQ ID NO: 7961 - RNA, 24 nt, Homo Sapiens
acacacacacucacacaucccauc

SEQ ID NO: 7962 - RNA, 25 nt, Homo Sapiens
acacacacacucacucacucacuca

SEQ ID NO: 7963 - RNA, 22 nt, Homo Sapiens
acacacacacacacacacacau

SEQ ID NO: 7964 - RNA, 20 nt, Homo Sapiens
acacacacacacacacacca

SEQ ID NO: 7965 - RNA, 24 nt, Homo Sapiens
acacacacagccacaaaccacuca

SEQ ID NO: 7966 - RNA, 21 nt, Homo Sapiens
acacacacacacacacaccau

SEQ ID NO: 7967 - RNA, 22 nt, Homo Sapiens
acacacacacacacacacauca

SEQ ID NO: 7968 - RNA, 23 nt, Homo Sapiens
acacacacaggcacgcacaacca

SEQ ID NO: 7969 - RNA, 23 nt, Homo Sapiens
acacacacauuccacacgcauca

SEQ ID NO: 7970 - RNA, 19 nt, Homo Sapiens
acacacacacacacaacca

SEQ ID NO: 7971 - RNA, 19 nt, Homo Sapiens
acacacacacacaccccca

SEQ ID NO: 7972 - RNA, 19 nt, Homo Sapiens
acacacacacccaucucca

SEQ ID NO: 7973 - RNA, 19 nt, Homo Sapiens
acacacacacucacaccca

SEQ ID NO: 7974 - RNA, 19 nt, Homo Sapiens
acacacacacucucugcca

SEQ ID NO: 7975 - RNA, 19 nt, Homo Sapiens
acacacacagacaaaacca

SEQ ID NO: 7976 - RNA, 20 nt, Homo Sapiens
acacacacacacacaaacau

SEQ ID NO: 7977 - RNA, 21 nt, Homo Sapiens
acacacacacacacacccauc

SEQ ID NO: 7978 - RNA, 21 nt, Homo Sapiens
acacacacacacacgaccauc

SEQ ID NO: 7979 - RNA, 21 nt, Homo Sapiens
acacacacacacacacaguca

SEQ ID NO: 7980 - RNA, 22 nt, Homo Sapiens
acacacacacacacaacuaaca

SEQ ID NO: 7981 - RNA, 23 nt, Homo Sapiens
gacaaagaccacucaccaccauc

SEQ ID NO: 7982 - RNA, 21 nt, Homo Sapiens
gaaacacacaguuacaccacc

SEQ ID NO: 7983 - RNA, 19 nt, Homo Sapiens
gacacacacacacacacac

SEQ ID NO: 7984 - RNA, 20 nt, Homo Sapiens
gacacacacagaggccacca

SEQ ID NO: 7985 - RNA, 20 nt, Homo Sapiens
gacacacacagacacacgau

SEQ ID NO: 7986 - RNA, 19 nt, Homo Sapiens
gacacacacggaacacaau

SEQ ID NO: 7987 - RNA, 23 nt, Homo Sapiens
ugacacacaccucuacucaccac

SEQ ID NO: 7988 - RNA, 24 nt, Homo Sapiens
ugucaccagaagucaccaccuuca

SEQ ID NO: 7989 - RNA, 20 nt, Homo Sapiens
ugacacacacacacacacac

SEQ ID NO: 7990 - RNA, 17 nt, Homo Sapiens
ugucacacacagaccac

SEQ ID NO: 7991 - RNA, 21 nt, Homo Sapiens
ugacacacacaccccacccuc

SEQ ID NO: 7992 - RNA, 61 nt, Homo Sapiens
uggcaggugguauuggggucccucagcccaccugggccgugaccucaaguguccacugcug

SEQ ID NO: 7993 - RNA, 22 nt, Homo Sapiens
ugaccucaaguguccacugcug

SEQ ID NO: 7994 - RNA, 22 nt, Homo Sapiens
accacaaaugcagccacugcug

SEQ ID NO: 7995 - RNA, 22 nt, Homo Sapiens
caggcaugggauuggggucucu

SEQ ID NO: 7996 - RNA, 21 nt, Homo Sapiens
caggugguaggaggguguccc

SEQ ID NO: 7997 - RNA, 19 nt, Homo Sapiens
caggcgccagugggguccc

SEQ ID NO: 7998 - RNA, 20 nt, Homo Sapiens
caugggguauuggggccucu

SEQ ID NO: 7999 - RNA, 22 nt, Homo Sapiens
gcagugugggguuugggguccc

SEQ ID NO: 8000 - RNA, 19 nt, Homo Sapiens
gcaggugguaagcuugggg

SEQ ID NO: 8001 - RNA, 20 nt, Homo Sapiens
gcaggacgcaggggucccuc

SEQ ID NO: 8002 - RNA, 22 nt, Homo Sapiens
gcagguggucuguggcucacuc

SEQ ID NO: 8003 - RNA, 22 nt, Homo Sapiens
gcaggugguguugcggugccuc

SEQ ID NO: 8004 - RNA, 24 nt, Homo Sapiens
ggcagguggagggugggggacccu

SEQ ID NO: 8005 - RNA, 22 nt, Homo Sapiens
ggcagguggauuacuugagguc

SEQ ID NO: 8006 - RNA, 22 nt, Homo Sapiens
ggcagguggauaacuugggguc

SEQ ID NO: 8007 - RNA, 21 nt, Homo Sapiens
ggcugggguaucugggguccc

SEQ ID NO: 8008 - RNA, 23 nt, Homo Sapiens
ggcagguggaauugugcaguccc

SEQ ID NO: 8009 - RNA, 19 nt, Homo Sapiens
ggaagcugguauugggauc

SEQ ID NO: 8010 - RNA, 18 nt, Homo Sapiens
ggcagugguuuggggucc

SEQ ID NO: 8011 - RNA, 18 nt, Homo Sapiens
ggcagguccuuggggucc

SEQ ID NO: 8012 - RNA, 19 nt, Homo Sapiens
ggcaggugggaggaguccc

SEQ ID NO: 8013 - RNA, 21 nt, Homo Sapiens
ggcaggugggaagggaggccc

SEQ ID NO: 8014 - RNA, 20 nt, Homo Sapiens
gggaggcggucugggguccc

SEQ ID NO: 8015 - RNA, 22 nt, Homo Sapiens
ggcagcacggaugggggucccu

SEQ ID NO: 8016 - RNA, 22 nt, Homo Sapiens
ggcagguggugaggggguuccu

SEQ ID NO: 8017 - RNA, 22 nt, Homo Sapiens
gguggugugugagggggucccu

SEQ ID NO: 8018 - RNA, 19 nt, Homo Sapiens
guggucauuuggggucccu

SEQ ID NO: 8019 - RNA, 23 nt, Homo Sapiens
uggccucaccacugccacugcug

SEQ ID NO: 8020 - RNA, 22 nt, Homo Sapiens
ugggagguuggggauugggguc

SEQ ID NO: 8021 - RNA, 22 nt, Homo Sapiens
uggcagguggcugugcuggggu

SEQ ID NO: 8022 - RNA, 21 nt, Homo Sapiens
uggcaggugggagggcugggg

SEQ ID NO: 8023 - RNA, 28 nt, Homo Sapiens
uggcagguggcaugagugcagggccccu

SEQ ID NO: 8024 - RNA, 21 nt, Homo Sapiens
uggcaggugggauggaugggg

SEQ ID NO: 8025 - RNA, 24 nt, Homo Sapiens
uggcagguggucuggaagcguccc

SEQ ID NO: 8026 - RNA, 76 nt, Homo Sapiens
uggccaagggccgcggccgcggaggccugcagcagcagaagcagcagaaaggccgcggcaugggcggcgcuggccg

SEQ ID NO: 8027 - RNA, 24 nt, Homo Sapiens
gcagaaaggccgcggcaugggcgg

SEQ ID NO: 8028 - RNA, 23 nt, Homo Sapiens
agaaaggccgggugccugggagg

SEQ ID NO: 8029 - RNA, 22 nt, Homo Sapiens
agaaaggccggccugaggacgg

SEQ ID NO: 8030 - RNA, 20 nt, Homo Sapiens
agaaaagaacaggcaugggc

SEQ ID NO: 8031 - RNA, 18 nt, Homo Sapiens
agaaaggcccugcagggc

SEQ ID NO: 8032 - RNA, 20 nt, Homo Sapiens
agaaaggccugggcguaggc

SEQ ID NO: 8033 - RNA, 20 nt, Homo Sapiens
aggaaggaaggggcaugggc

SEQ ID NO: 8034 - RNA, 19 nt, Homo Sapiens
aggccaccagggcaugggc

SEQ ID NO: 8035 - RNA, 25 nt, Homo Sapiens
cagacaaggccgcgugcugcagggc

SEQ ID NO: 8036 - RNA, 22 nt, Homo Sapiens
cagaaaggcgggcggaaggggc

SEQ ID NO: 8037 - RNA, 19 nt, Homo Sapiens
cagaaaggccaccaugggc

SEQ ID NO: 8038 - RNA, 20 nt, Homo Sapiens
cagaaaggcuggggcugagc

SEQ ID NO: 8039 - RNA, 21 nt, Homo Sapiens
caguaaagcaggggcaugggc

SEQ ID NO: 8040 - RNA, 22 nt, Homo Sapiens
caggaaggccgcgaugugugcg

SEQ ID NO: 8041 - RNA, 20 nt, Homo Sapiens
gagaggcaggaggcaugggc

SEQ ID NO: 8042 - RNA, 22 nt, Homo Sapiens
gaaaggccgggcggagaggcgg

SEQ ID NO: 8043 - RNA, 18 nt, Homo Sapiens
gaaaggccgaggggccgg

SEQ ID NO: 8044 - RNA, 23 nt, Homo Sapiens
gcagaaaggggcccucgaugggc

SEQ ID NO: 8045 - RNA, 20 nt, Homo Sapiens
gcagaaaggaccacagaugg

SEQ ID NO: 8046 - RNA, 19 nt, Homo Sapiens
gcagaaaggcaggcgaggc

SEQ ID NO: 8047 - RNA, 19 nt, Homo Sapiens
gcagaaaggagcguccugg

SEQ ID NO: 8048 - RNA, 19 nt, Homo Sapiens
gcagaaagggcagcauugg

SEQ ID NO: 8049 - RNA, 21 nt, Homo Sapiens
gcagaaaggagggugccuggg

SEQ ID NO: 8050 - RNA, 20 nt, Homo Sapiens
ggccgcggcgccaagggagg

SEQ ID NO: 8051 - RNA, 80 nt, Homo Sapiens
ugggauggcaaaguuuguuggcucagacuguugcuaacaggaacucugaagcccgggcuuucaagccagaaacaaucuca

SEQ ID NO: 8052 - RNA, 24 nt, Homo Sapiens
uggcaaaguuuguuggcucagacu

SEQ ID NO: 8053 - RNA, 19 nt, Homo Sapiens
aaaguucuccuguuggcuc

SEQ ID NO: 8054 - RNA, 19 nt, Homo Sapiens
aaagugugaauggcucaga

SEQ ID NO: 8055 - RNA, 24 nt, Homo Sapiens
caaaguuuguuuguugcugaaacu

SEQ ID NO: 8056 - RNA, 22 nt, Homo Sapiens
cacaguguguuucuggcucaga

SEQ ID NO: 8057 - RNA, 20 nt, Homo Sapiens
gcaaaguuuugucgauggcu

SEQ ID NO: 8058 - RNA, 25 nt, Homo Sapiens
gggaaggucuauuuuggcucaggcu

SEQ ID NO: 8059 - RNA, 24 nt, Homo Sapiens
gggacagucuugguagcucagacu

SEQ ID NO: 8060 - RNA, 24 nt, Homo Sapiens
gggacagucauguuggcucagccu

SEQ ID NO: 8061 - RNA, 19 nt, Homo Sapiens
ggcaaaguuucugguuggc

SEQ ID NO: 8062 - RNA, 23 nt, Homo Sapiens
ggaaaaggaugugaggcucagac

SEQ ID NO: 8063 - RNA, 20 nt, Homo Sapiens
gggaagguuuguuggucuga

SEQ ID NO: 8064 - RNA, 19 nt, Homo Sapiens
ugguaacagguuguuggcu

SEQ ID NO: 8065 - RNA, 25 nt, Homo Sapiens
ugggaaagagguaugauggcucaga

SEQ ID NO: 8066 - RNA, 20 nt, Homo Sapiens
uggcacugugguuguuggcu

SEQ ID NO: 8067 - RNA, 21 nt, Homo Sapiens
uggcaaaguguugaugacuca

SEQ ID NO: 8068 - RNA, 20 nt, Homo Sapiens
uggcaaguuacuguuggcuc

SEQ ID NO: 8069 - RNA, 19 nt, Homo Sapiens
uggcacaguuuguugacuc

SEQ ID NO: 8070 - RNA, 22 nt, Homo Sapiens
uggcauucucuuuggcucagac

SEQ ID NO: 8071 - RNA, 68 nt, Homo Sapiens
ugggcaggguccgcugaucgugggcaucuugcugguguugauggcuguggucuaugcaucucugaaua

SEQ ID NO: 8072 - RNA, 24 nt, Homo Sapiens
uggcuguggucuaugcaucucuga

SEQ ID NO: 8073 - RNA, 25 nt, Homo Sapiens
cuguggucucagucuguauaucuga

SEQ ID NO: 8074 - RNA, 19 nt, Homo Sapiens
cuguggucugaugcuccuc

SEQ ID NO: 8075 - RNA, 19 nt, Homo Sapiens
cugucucuaagcaucucug

SEQ ID NO: 8076 - RNA, 21 nt, Homo Sapiens
gcuguggucccguccuucucu

SEQ ID NO: 8077 - RNA, 22 nt, Homo Sapiens
gcuguggucucuuccagcucug

SEQ ID NO: 8078 - RNA, 18 nt, Homo Sapiens
gcugggucagcaucucug

SEQ ID NO: 8079 - RNA, 18 nt, Homo Sapiens
gcuguggucucaacucug

SEQ ID NO: 8080 - RNA, 17 nt, Homo Sapiens
ggcugugguuaucaucu

SEQ ID NO: 8081 - RNA, 20 nt, Homo Sapiens
ggcugugguagaggcagcuc

SEQ ID NO: 8082 - RNA, 21 nt, Homo Sapiens
ggcugaggggagugcaucucu

SEQ ID NO: 8083 - RNA, 22 nt, Homo Sapiens
ggcagcgguggaggcaucucug

SEQ ID NO: 8084 - RNA, 16 nt, Homo Sapiens
uggcuguggaugcauc

SEQ ID NO: 8085 - RNA, 16 nt, Homo Sapiens
uggcugugguggcauc

SEQ ID NO: 8086 - RNA, 24 nt, Homo Sapiens
uggcugugggaugcauauuccuga

SEQ ID NO: 8087 - RNA, 23 nt, Homo Sapiens
uggccgaggaaugugcaucucug

SEQ ID NO: 8088 - RNA, 22 nt, Homo Sapiens
uggcuguggcuuugucccucug

SEQ ID NO: 8089 - RNA, 22 nt, Homo Sapiens
uggcugugguuuugaacacuga

SEQ ID NO: 8090 - RNA, 23 nt, Homo Sapiens
ugugugucuauaugcaucuguga

SEQ ID NO: 8091 - RNA, 74 nt, Homo Sapiens
uggggcugagaggcgagacacugauggcacucuuacuucugucagcugccgcaaagucucguccacuugcugca

SEQ ID NO: 8092 - RNA, 24 nt, Homo Sapiens
ugagaggcgagacacugauggcac

SEQ ID NO: 8093 - RNA, 18 nt, Homo Sapiens
agaggaagacacugaggg

SEQ ID NO: 8094 - RNA, 21 nt, Homo Sapiens
agaugucagacacugaggaca

SEQ ID NO: 8095 - RNA, 20 nt, Homo Sapiens
aggagaugacacugauuggc

SEQ ID NO: 8096 - RNA, 19 nt, Homo Sapiens
gagggaggagacacugaug

SEQ ID NO: 8097 - RNA, 23 nt, Homo Sapiens
gagugggagacacugcuggacac

SEQ ID NO: 8098 - RNA, 23 nt, Homo Sapiens
gagagauuauacacugaugggac

SEQ ID NO: 8099 - RNA, 19 nt, Homo Sapiens
gaggcgagaccagaccgca

SEQ ID NO: 8100 - RNA, 19 nt, Homo Sapiens
gaggcgagacucgccggca

SEQ ID NO: 8101 - RNA, 18 nt, Homo Sapiens
gaggcgaacugauggcac

SEQ ID NO: 8102 - RNA, 21 nt, Homo Sapiens
gaggcgagacgcggccgccac

SEQ ID NO: 8103 - RNA, 19 nt, Homo Sapiens
ugagcugcaggagacacug

SEQ ID NO: 8104 - RNA, 20 nt, Homo Sapiens
ugaaaagagcagacacugau

SEQ ID NO: 8105 - RNA, 19 nt, Homo Sapiens
ugggagcccagacacugau

SEQ ID NO: 8106 - RNA, 22 nt, Homo Sapiens
ugagaggcgaaaacagcucggc

SEQ ID NO: 8107 - RNA, 21 nt, Homo Sapiens
ugggcggggguacacugaugg

SEQ ID NO: 8108 - RNA, 20 nt, Homo Sapiens
ugacuggcagacacugaggc

SEQ ID NO: 8109 - RNA, 83 nt, Homo Sapiens
ugggucuguuuacagagugugguaauuucguucuuuagauuugcagaauuuauaaagaaagaaaauuacagccugcacaccca

SEQ ID NO: 8110 - RNA, 24 nt, Homo Sapiens
uauaaagaaagaaaauuacagccu

SEQ ID NO: 8111 - RNA, 20 nt, Homo Sapiens
aaagaaaagaaaaugacagc

SEQ ID NO: 8112 - RNA, 21 nt, Homo Sapiens
aaagaaagaaaaauugcaucc

SEQ ID NO: 8113 - RNA, 18 nt, Homo Sapiens
aaagaaagaaaaaucagc

SEQ ID NO: 8114 - RNA, 19 nt, Homo Sapiens
aaagaaagaaaaaugaagc

SEQ ID NO: 8115 - RNA, 21 nt, Homo Sapiens
aagaaccaaaauuacaggccu

SEQ ID NO: 8116 - RNA, 19 nt, Homo Sapiens
aagaaagaaaaacacaacc

SEQ ID NO: 8117 - RNA, 19 nt, Homo Sapiens
aagaaagaaagaaaaagcc

SEQ ID NO: 8118 - RNA, 19 nt, Homo Sapiens
aagaaagaaagaaacaacc

SEQ ID NO: 8119 - RNA, 21 nt, Homo Sapiens
auaaagugaaagaaaauacag

SEQ ID NO: 8120 - RNA, 21 nt, Homo Sapiens
auauagaaagaaacuccuaca

SEQ ID NO: 8121 - RNA, 18 nt, Homo Sapiens
auaaagcaaaaaauuaca

SEQ ID NO: 8122 - RNA, 20 nt, Homo Sapiens
auaaagaaagaaauauccag

SEQ ID NO: 8123 - RNA, 20 nt, Homo Sapiens
auaaagaaaggugaguacag

SEQ ID NO: 8124 - RNA, 21 nt, Homo Sapiens
auauaaaagaaaauacagccu

SEQ ID NO: 8125 - RNA, 16 nt, Homo Sapiens
uaaaggaaaauuacag

SEQ ID NO: 8126 - RNA, 18 nt, Homo Sapiens
uagagaaagaaaauacag

SEQ ID NO: 8127 - RNA, 21 nt, Homo Sapiens
uaugaaagaaagaaacuucag

SEQ ID NO: 8128 - RNA, 21 nt, Homo Sapiens
uauauaagaaaaaaauuacag

SEQ ID NO: 8129 - RNA, 22 nt, Homo Sapiens
uauaaaggaaaaagaaaauaac

SEQ ID NO: 8130 - RNA, 23 nt, Homo Sapiens
uauaaaggaaaagaaaaucaagc

SEQ ID NO: 8131 - RNA, 20 nt, Homo Sapiens
uauaaagaaugaauauaaca

SEQ ID NO: 8132 - RNA, 20 nt, Homo Sapiens
uauauagaaagaaaaacaca

SEQ ID NO: 8133 - RNA, 21 nt, Homo Sapiens
uaaaaagucaaaaaauuacag

SEQ ID NO: 8134 - RNA, 21 nt, Homo Sapiens
uauaaagaaaaaaaaauccag

SEQ ID NO: 8135 - RNA, 24 nt, Homo Sapiens
uauaacaaauggaaauuacagacu

SEQ ID NO: 8136 - RNA, 67 nt, Homo Sapiens
uggugagguauaggaguuggaguuucgcaaauagccugagaccuugagaacauuuccuuccucacca

SEQ ID NO: 8137 - RNA, 24 nt, Homo Sapiens
ugagaccuugagaacauuuccuuc

SEQ ID NO: 8138 - RNA, 20 nt, Homo Sapiens
accuugaaacauuucccuuc

SEQ ID NO: 8139 - RNA, 19 nt, Homo Sapiens
accuugagaauuuucccuc

SEQ ID NO: 8140 - RNA, 18 nt, Homo Sapiens
accuuuaacauuuccuuc

SEQ ID NO: 8141 - RNA, 21 nt, Homo Sapiens
agaacuuuggacaacauuucc

SEQ ID NO: 8142 - RNA, 21 nt, Homo Sapiens
agacauucagacauuuccuuc

SEQ ID NO: 8143 - RNA, 19 nt, Homo Sapiens
ccaugcaggacauuuccuu

SEQ ID NO: 8144 - RNA, 23 nt, Homo Sapiens
ugagagccacgauugagaacauu

SEQ ID NO: 8145 - RNA, 25 nt, Homo Sapiens
ugagacacauuugacagaacauuuc

SEQ ID NO: 8146 - RNA, 20 nt, Homo Sapiens
ugagacaucagagaacauuu

SEQ ID NO: 8147 - RNA, 19 nt, Homo Sapiens
ugagaccuugauauaauuu

SEQ ID NO: 8148 - RNA, 22 nt, Homo Sapiens
ugaauccugaguucauuuccuu

SEQ ID NO: 8149 - RNA, 68 nt, Homo Sapiens
uggugggccccaggcccucgugcagaucaugcguaacuacaguuaugaaaagcugcucuggaccacca

SEQ ID NO: 8150 - RNA, 23 nt, Homo Sapiens
ugaaaagcugcucuggaccacca

SEQ ID NO: 8151 - RNA, 22 nt, Homo Sapiens
aagagcugauaaccuggaccac

SEQ ID NO: 8152 - RNA, 21 nt, Homo Sapiens
aaaagcugcuuaguagcaaca

SEQ ID NO: 8153 - RNA, 21 nt, Homo Sapiens
gaacaguugacucuggaccac

SEQ ID NO: 8154 - RNA, 23 nt, Homo Sapiens
gaaaagcugcucagcugccccac

SEQ ID NO: 8155 - RNA, 21 nt, Homo Sapiens
gaaaagcuguggugcacuacc

SEQ ID NO: 8156 - RNA, 18 nt, Homo Sapiens
gaaaagcagggaccacca

SEQ ID NO: 8157 - RNA, 22 nt, Homo Sapiens
gaaaagcugcucuaugucacca

SEQ ID NO: 8158 - RNA, 26 nt, Homo Sapiens
ugaaaggcuuugcuucaggaccacca

SEQ ID NO: 8159 - RNA, 19 nt, Homo Sapiens
ugaaaagcuccuuguggac

SEQ ID NO: 8160 - RNA, 21 nt, Homo Sapiens
ugaauagcacuccuggaccac

SEQ ID NO: 8161 - RNA, 20 nt, Homo Sapiens
uguaaagcugcuguaaacca

SEQ ID NO: 8162 - RNA, 115 nt, Homo Sapiens
ugguucauagaagcagccaccagcagaugacaaagaagcuucaguucuccuuaaagaaguuagggguaggacaaguaucucgugguauugaagaggugaauauguuuacaaacca

SEQ ID NO: 8163 - RNA, 24 nt, Homo Sapiens
ugacaaagaagcuucaguucuccu

SEQ ID NO: 8164 - RNA, 17 nt, Homo Sapiens
aaagaagcucaguuucc

SEQ ID NO: 8165 - RNA, 20 nt, Homo Sapiens
aacaacuucccaguucuccu

SEQ ID NO: 8166 - RNA, 23 nt, Homo Sapiens
acacaacagucuucaguucuucu

SEQ ID NO: 8167 - RNA, 19 nt, Homo Sapiens
acaaagaagguacacuucu

SEQ ID NO: 8168 - RNA, 21 nt, Homo Sapiens
acaaagaagauccuggugucc

SEQ ID NO: 8169 - RNA, 21 nt, Homo Sapiens
agaagcuaauucaguucuccu

SEQ ID NO: 8170 - RNA, 17 nt, Homo Sapiens
caaagaagccauuucuc

SEQ ID NO: 8171 - RNA, 20 nt, Homo Sapiens
cacagaagcuucauguaucc

SEQ ID NO: 8172 - RNA, 20 nt, Homo Sapiens
cauagaagguacaguucucc

SEQ ID NO: 8173 - RNA, 19 nt, Homo Sapiens
caaagaagcaagcuguccu

SEQ ID NO: 8174 - RNA, 18 nt, Homo Sapiens
cacagaaucaguucuccu

SEQ ID NO: 8175 - RNA, 21 nt, Homo Sapiens
cacagaagcuucccauauccu

SEQ ID NO: 8176 - RNA, 21 nt, Homo Sapiens
cacagcaacuugaguucuccu

SEQ ID NO: 8177 - RNA, 19 nt, Homo Sapiens
gacaaagaagauacuugag

SEQ ID NO: 8178 - RNA, 26 nt, Homo Sapiens
gacaaagaagacaucggagggcuccu

SEQ ID NO: 8179 - RNA, 22 nt, Homo Sapiens
gacaaagaaacagcagaaucuc

SEQ ID NO: 8180 - RNA, 19 nt, Homo Sapiens
ugacaaagaggaguuucag

SEQ ID NO: 8181 - RNA, 22 nt, Homo Sapiens
ugacaaagaauagcuuaaauuc

SEQ ID NO: 8182 - RNA, 20 nt, Homo Sapiens
ugaaaaauauagcuucaguu

SEQ ID NO: 8183 - RNA, 26 nt, Homo Sapiens
ugaaaagaagcugcuugcuguucucc

SEQ ID NO: 8184 - RNA, 17 nt, Homo Sapiens
ugacaaagaauucaauu

SEQ ID NO: 8185 - RNA, 21 nt, Homo Sapiens
ugacaaagaggacucagcucu

SEQ ID NO: 8186 - RNA, 22 nt, Homo Sapiens
ugaaagagaccuuucaguucuc

SEQ ID NO: 8187 - RNA, 73 nt, Homo Sapiens
ugguuuugguggcccaggcugggagugcaagggcgcaaucucagcucagugaaaccucggccucccgugucca

SEQ ID NO: 8188 - RNA, 24 nt, Homo Sapiens
ucucagcucagugaaaccucggcc

SEQ ID NO: 8189 - RNA, 17 nt, Homo Sapiens
agccaugaaaccucugc

SEQ ID NO: 8190 - RNA, 24 nt, Homo Sapiens
cagcucagucgcagagaccgcggc

SEQ ID NO: 8191 - RNA, 19 nt, Homo Sapiens
gcucagugaagcgcuucgg

SEQ ID NO: 8192 - RNA, 21 nt, Homo Sapiens
ucagcucagugggcccccggc

SEQ ID NO: 8193 - RNA, 25 nt, Homo Sapiens
ucacagggcccugcaaaccucggcc

SEQ ID NO: 8194 - RNA, 20 nt, Homo Sapiens
ucucagcucacugcaaccuc

SEQ ID NO: 8195 - RNA, 20 nt, Homo Sapiens
ucucggcucacugaaaccuc

SEQ ID NO: 8196 - RNA, 19 nt, Homo Sapiens
ucucagcucugcaccucgg

SEQ ID NO: 8197 - RNA, 23 nt, Homo Sapiens
ucucagcucacugcaaccuccgc

SEQ ID NO: 8198 - RNA, 24 nt, Homo Sapiens
ucucagcucaaugcaaccuccgcc

SEQ ID NO: 8199 - RNA, 24 nt, Homo Sapiens
ucucagcucaccccaaccucugcc

SEQ ID NO: 8200 - RNA, 24 nt, Homo Sapiens
ucucagcucacuacaaccucugcc

SEQ ID NO: 8201 - RNA, 24 nt, Homo Sapiens
ucucagcucacugcaaccuccgcc

SEQ ID NO: 8202 - RNA, 24 nt, Homo Sapiens
ucucagcucacugcaaccucugcc

SEQ ID NO: 8203 - RNA, 24 nt, Homo Sapiens
ucucagcucacugcaagcuccgcc

SEQ ID NO: 8204 - RNA, 24 nt, Homo Sapiens
ucucagcucacugcaagcucugcc

SEQ ID NO: 8205 - RNA, 24 nt, Homo Sapiens
ucucagcucacugcaaucuccgcc

SEQ ID NO: 8206 - RNA, 24 nt, Homo Sapiens
ucucagcucacugccagcuccgcc

SEQ ID NO: 8207 - RNA, 24 nt, Homo Sapiens
ucucagcucgcugcaaccuccgcc

SEQ ID NO: 8208 - RNA, 24 nt, Homo Sapiens
ucucagcucgcugcaaccucugcc

SEQ ID NO: 8209 - RNA, 24 nt, Homo Sapiens
ucugggcucacugaaaccucugcc

SEQ ID NO: 8210 - RNA, 74 nt, Homo Sapiens
ugucccauagagcuuuugcauccucuggauguauugcgaaagaaauguccagacuuugagggcuacaggguaca

SEQ ID NO: 8211 - RNA, 24 nt, Homo Sapiens
guccagacuuugagggcuacaggg

SEQ ID NO: 8212 - RNA, 19 nt, Homo Sapiens
ccaaauauugagggcuaca

SEQ ID NO: 8213 - RNA, 20 nt, Homo Sapiens
ccagacuuugggguuucugg

SEQ ID NO: 8214 - RNA, 18 nt, Homo Sapiens
ccagacuuugaagacagg

SEQ ID NO: 8215 - RNA, 19 nt, Homo Sapiens
cugugagggcuaagcaggg

SEQ ID NO: 8216 - RNA, 19 nt, Homo Sapiens
guccagacuuucaggacag

SEQ ID NO: 8217 - RNA, 21 nt, Homo Sapiens
uccgguacuuugaggucuaca

SEQ ID NO: 8218 - RNA, 81 nt, Homo Sapiens
ugucuauggaaaugugaauaaaggcaauccaugaauaggucaacuucuuccuggguaaccuccccagguguuuuguggaca

SEQ ID NO: 8219 - RNA, 24 nt, Homo Sapiens
ugugaauaaaggcaauccaugaau

SEQ ID NO: 8220 - RNA, 21 nt, Homo Sapiens
aagaaaagcauauccaugaau

SEQ ID NO: 8221 - RNA, 21 nt, Homo Sapiens
aauaaugccaguuccaugaau

SEQ ID NO: 8222 - RNA, 21 nt, Homo Sapiens
auaaaggcaacauaccugaau

SEQ ID NO: 8223 - RNA, 17 nt, Homo Sapiens
auaaaggcaacaggaau

SEQ ID NO: 8224 - RNA, 16 nt, Homo Sapiens
gugaauaaaaauccau

SEQ ID NO: 8225 - RNA, 17 nt, Homo Sapiens
gugaauaaaggaucuau

SEQ ID NO: 8226 - RNA, 19 nt, Homo Sapiens
gugaauaaaggaagacaug

SEQ ID NO: 8227 - RNA, 20 nt, Homo Sapiens
guggauacaaucaauccaug

SEQ ID NO: 8228 - RNA, 21 nt, Homo Sapiens
ugaacugaaauccaauccaug

SEQ ID NO: 8229 - RNA, 23 nt, Homo Sapiens
ugaaagagggcaauccaaaugaa

SEQ ID NO: 8230 - RNA, 19 nt, Homo Sapiens
ugaauaaagggaaaacaug

SEQ ID NO: 8231 - RNA, 18 nt, Homo Sapiens
uguacaaagcaauccaug

SEQ ID NO: 8232 - RNA, 22 nt, Homo Sapiens
ugugaacugaaggcaaucugaa

SEQ ID NO: 8233 - RNA, 20 nt, Homo Sapiens
ugugaauaagagguaagcca

SEQ ID NO: 8234 - RNA, 20 nt, Homo Sapiens
ugugaauaaagaucacucca

SEQ ID NO: 8235 - RNA, 23 nt, Homo Sapiens
ugugaauaaaauuccaaaugaau

SEQ ID NO: 8236 - RNA, 61 nt, Homo Sapiens
ugugaaucaccggcagagccugguggagcuggaggaccgguuccugggccugacagacaca

SEQ ID NO: 8237 - RNA, 24 nt, Homo Sapiens
ucaccggcagagccugguggagcu

SEQ ID NO: 8238 - RNA, 19 nt, Homo Sapiens
accaggcagggccuggugg

SEQ ID NO: 8239 - RNA, 20 nt, Homo Sapiens
accggcagaaccuucuggag

SEQ ID NO: 8240 - RNA, 21 nt, Homo Sapiens
caccagggcagagcccgcugg

SEQ ID NO: 8241 - RNA, 17 nt, Homo Sapiens
cacagggagccuggugg

SEQ ID NO: 8242 - RNA, 16 nt, Homo Sapiens
cacccagcugguggag

SEQ ID NO: 8243 - RNA, 21 nt, Homo Sapiens
ccagcaggaagccugguggag

SEQ ID NO: 8244 - RNA, 22 nt, Homo Sapiens
ccggcagagcugcuagcggcgc

SEQ ID NO: 8245 - RNA, 23 nt, Homo Sapiens
ccggcagagcccggagcgggagc

SEQ ID NO: 8246 - RNA, 17 nt, Homo Sapiens
ccggcagaggggcggag

SEQ ID NO: 8247 - RNA, 20 nt, Homo Sapiens
ccggcgucaccugguggagc

SEQ ID NO: 8248 - RNA, 21 nt, Homo Sapiens
cggcugagccugguccgagcu

SEQ ID NO: 8249 - RNA, 18 nt, Homo Sapiens
cggcagagcugguggcgc

SEQ ID NO: 8250 - RNA, 18 nt, Homo Sapiens
gcagcagccuggugggcu

SEQ ID NO: 8251 - RNA, 22 nt, Homo Sapiens
gcagagccugggguccggagcu

SEQ ID NO: 8252 - RNA, 19 nt, Homo Sapiens
gcagagccuuagggggagc

SEQ ID NO: 8253 - RNA, 23 nt, Homo Sapiens
ucacccaaagccuggguggagcu

SEQ ID NO: 8254 - RNA, 86 nt, Homo Sapiens
ugugcaucccagcaguaagcaacaauggcugauccagaagguacagacggggagggcacggguuguaacggcugguuuuauguaca

SEQ ID NO: 8255 - RNA, 24 nt, Homo Sapiens
ucccagcaguaagcaacaauggcu

SEQ ID NO: 8256 - RNA, 19 nt, Homo Sapiens
agcaguaagcaggaacugg

SEQ ID NO: 8257 - RNA, 19 nt, Homo Sapiens
cagcauuaacagcaacaau

SEQ ID NO: 8258 - RNA, 19 nt, Homo Sapiens
ccaggucaguaagcaucaa

SEQ ID NO: 8259 - RNA, 23 nt, Homo Sapiens
ccagcagaucuucuacaauggcu

SEQ ID NO: 8260 - RNA, 19 nt, Homo Sapiens
ccagcaguaaguaaaaugg

SEQ ID NO: 8261 - RNA, 17 nt, Homo Sapiens
cccaacaagcaacaaug

SEQ ID NO: 8262 - RNA, 22 nt, Homo Sapiens
cccagcagugggaaacacuggc

SEQ ID NO: 8263 - RNA, 18 nt, Homo Sapiens
cccagcagucaacaggcu

SEQ ID NO: 8264 - RNA, 16 nt, Homo Sapiens
gcagaaaacaauggcu

SEQ ID NO: 8265 - RNA, 27 nt, Homo Sapiens
ucccagcaggaagcccacaacacuggc

SEQ ID NO: 8266 - RNA, 23 nt, Homo Sapiens
uccuaauaguaagcaagcaaagg

SEQ ID NO: 8267 - RNA, 18 nt, Homo Sapiens
ucccagcagucagcacaa

SEQ ID NO: 8268 - RNA, 20 nt, Homo Sapiens
uccugguaggcagcaacaau

SEQ ID NO: 8269 - RNA, 22 nt, Homo Sapiens
ucccagcagaaccccacacugg

SEQ ID NO: 8270 - RNA, 20 nt, Homo Sapiens
ucccagcagugcagccuggc

SEQ ID NO: 8271 - RNA, 23 nt, Homo Sapiens
ucccagcagcgggaacaagggcu

SEQ ID NO: 8272 - RNA, 68 nt, Homo Sapiens
uguguggugaucgaguggucuguguuccuauugcugguggggugauagggugggcuaaaaaccaugca

SEQ ID NO: 8273 - RNA, 23 nt, Homo Sapiens
uagggugggcuaaaaaccaugca

SEQ ID NO: 8274 - RNA, 23 nt, Homo Sapiens
agggugggcuucagagaaaacca

SEQ ID NO: 8275 - RNA, 21 nt, Homo Sapiens
agggugggcuagcuaaccugc

SEQ ID NO: 8276 - RNA, 22 nt, Homo Sapiens
gggugggagagccaaaaccaug

SEQ ID NO: 8277 - RNA, 21 nt, Homo Sapiens
gguuuggugaaaaaccauaca

SEQ ID NO: 8278 - RNA, 20 nt, Homo Sapiens
gguggccaucaaaccaugca

SEQ ID NO: 8279 - RNA, 20 nt, Homo Sapiens
uagggugggucacuauaaac

SEQ ID NO: 8280 - RNA, 19 nt, Homo Sapiens
uagggugggcccuaaucca

SEQ ID NO: 8281 - RNA, 21 nt, Homo Sapiens
uagggugggcaggacacuaug

SEQ ID NO: 8282 - RNA, 19 nt, Homo Sapiens
ugguccaaauaaccaugca

SEQ ID NO: 8283 - RNA, 77 nt, Homo Sapiens
uguucuuggugagaagggccggcggauucgggaacugacugcuguaguucagaagagguuuggcuuuccagagggca

SEQ ID NO: 8284 - RNA, 24 nt, Homo Sapiens
ugagaagggccggcggauucggga

SEQ ID NO: 8285 - RNA, 21 nt, Homo Sapiens
agggccggcgcuuggucggga

SEQ ID NO: 8286 - RNA, 18 nt, Homo Sapiens
agggccggcgggucugga

SEQ ID NO: 8287 - RNA, 19 nt, Homo Sapiens
agggccggcgggcccggga

SEQ ID NO: 8288 - RNA, 22 nt, Homo Sapiens
gaagggccggugcgcucaggga

SEQ ID NO: 8289 - RNA, 19 nt, Homo Sapiens
gagaagggccuggaggauu

SEQ ID NO: 8290 - RNA, 17 nt, Homo Sapiens
gagaagggccaggauuc

SEQ ID NO: 8291 - RNA, 21 nt, Homo Sapiens
gagaagggcggaggguugggg

SEQ ID NO: 8292 - RNA, 20 nt, Homo Sapiens
gagaagggcgccgacucggg

SEQ ID NO: 8293 - RNA, 22 nt, Homo Sapiens
gagaagggcaggcagacugggg

SEQ ID NO: 8294 - RNA, 21 nt, Homo Sapiens
gagaagggcugugauucugga

SEQ ID NO: 8295 - RNA, 19 nt, Homo Sapiens
gggccggcggaggacggga

SEQ ID NO: 8296 - RNA, 20 nt, Homo Sapiens
gggccggcggcuggccggga

SEQ ID NO: 8297 - RNA, 19 nt, Homo Sapiens
ugagaagggaaggccauuc

SEQ ID NO: 8298 - RNA, 21 nt, Homo Sapiens
ugagaagggcagggauccagg

SEQ ID NO: 8299 - RNA, 23 nt, Homo Sapiens
ugagaaggguggucagaauggga

SEQ ID NO: 8300 - RNA, 82 nt, Homo Sapiens
uguugagaugaggguuucagggaagcagaaaaaccaagugcuggaucauuucuccuuugaggggccuuuguccaauucagca

SEQ ID NO: 8301 - RNA, 24 nt, Homo Sapiens
ugaggguuucagggaagcagaaaa

SEQ ID NO: 8302 - RNA, 21 nt, Homo Sapiens
agggugagagggaagcaggaa

SEQ ID NO: 8303 - RNA, 20 nt, Homo Sapiens
gaggguuucauuggaagaga

SEQ ID NO: 8304 - RNA, 30 nt, Homo Sapiens
gaggguuucagccggaaggcaucaagaaaa

SEQ ID NO: 8305 - RNA, 22 nt, Homo Sapiens
gaggggucagacggaagcagaa

SEQ ID NO: 8306 - RNA, 19 nt, Homo Sapiens
gaggguuucagaggagaga

SEQ ID NO: 8307 - RNA, 23 nt, Homo Sapiens
ggguuucaggagaaaguaggaaa

SEQ ID NO: 8308 - RNA, 22 nt, Homo Sapiens
ggguugaaggguuagcagaaaa

SEQ ID NO: 8309 - RNA, 18 nt, Homo Sapiens
ggcugucagggaaggaaa

SEQ ID NO: 8310 - RNA, 16 nt, Homo Sapiens
guuucacagcagaaaa

SEQ ID NO: 8311 - RNA, 20 nt, Homo Sapiens
ugagauguuucagggaugca

SEQ ID NO: 8312 - RNA, 19 nt, Homo Sapiens
ugaggguuuccauggaagc

SEQ ID NO: 8313 - RNA, 25 nt, Homo Sapiens
ugaggguuucugauuaaagcaguaa

SEQ ID NO: 8314 - RNA, 22 nt, Homo Sapiens
ugaagguuucaggagaaugcag

SEQ ID NO: 8315 - RNA, 20 nt, Homo Sapiens
ugggagcuucagggaagcag

SEQ ID NO: 8316 - RNA, 20 nt, Homo Sapiens
ugaggguuucacugaagaga

SEQ ID NO: 8317 - RNA, 20 nt, Homo Sapiens
ugaugguuucuggaagcaga

SEQ ID NO: 8318 - RNA, 18 nt, Homo Sapiens
ugaggguuugaagcagaa

SEQ ID NO: 8319 - RNA, 72 nt, Homo Sapiens
uguugagugcagaugaaggguuguaugaggccccauccugggagggcuguacaccuucuuggcacagcagca

SEQ ID NO: 8320 - RNA, 24 nt, Homo Sapiens
ugaaggguuguaugaggccccauc

SEQ ID NO: 8321 - RNA, 22 nt, Homo Sapiens
aaggguuguacaggauccccau

SEQ ID NO: 8322 - RNA, 19 nt, Homo Sapiens
aggaugggaggaggcccca

SEQ ID NO: 8323 - RNA, 24 nt, Homo Sapiens
gaagagguuguauggagccuccau

SEQ ID NO: 8324 - RNA, 20 nt, Homo Sapiens
gaaggguuggacguugaggc

SEQ ID NO: 8325 - RNA, 18 nt, Homo Sapiens
gaaggguugaucaggacc

SEQ ID NO: 8326 - RNA, 20 nt, Homo Sapiens
gggucucgucugaggcccca

SEQ ID NO: 8327 - RNA, 22 nt, Homo Sapiens
ggguucuggcuguggccccauc

SEQ ID NO: 8328 - RNA, 19 nt, Homo Sapiens
gguuuguaugaguucgcau

SEQ ID NO: 8329 - RNA, 20 nt, Homo Sapiens
ggcugaauuagggccccauc

SEQ ID NO: 8330 - RNA, 21 nt, Homo Sapiens
ugaggguguaggaugaggccc

SEQ ID NO: 8331 - RNA, 20 nt, Homo Sapiens
ugaaggguuugggauggggc

SEQ ID NO: 8332 - RNA, 19 nt, Homo Sapiens
ugcaggguuguagaugucc

SEQ ID NO: 8333 - RNA, 20 nt, Homo Sapiens
ugagggggucugaggcccca

SEQ ID NO: 8334 - RNA, 23 nt, Homo Sapiens
ugaaggguugucgcccgccccau

SEQ ID NO: 8335 - RNA, 68 nt, Homo Sapiens
uguuucaugacugguaacagaguagucucgaggggauccuuggagaaccuguucugacuuuagaagca

SEQ ID NO: 8336 - RNA, 24 nt, Homo Sapiens
ugacugguaacagaguagucucga

SEQ ID NO: 8337 - RNA, 18 nt, Homo Sapiens
cuggauaacagaguaucu

SEQ ID NO: 8338 - RNA, 20 nt, Homo Sapiens
cuggcaacagaguaagacuc

SEQ ID NO: 8339 - RNA, 25 nt, Homo Sapiens
ugacugagguaacagauacuguaga

SEQ ID NO: 8340 - RNA, 20 nt, Homo Sapiens
ugacugguaagggaucuagu

SEQ ID NO: 8341 - RNA, 23 nt, Homo Sapiens
ugccugacagaguagguacucga

SEQ ID NO: 8342 - RNA, 18 nt, Homo Sapiens
ugacguguaacagagagu

SEQ ID NO: 8343 - RNA, 18 nt, Homo Sapiens
uggcuggcacagaguagu

SEQ ID NO: 8344 - RNA, 75 nt, Homo Sapiens
uuaaacaugucaccuaaaugcacuugaugguguugaaaugugcaccuucuuaaauuuuaagaugacuuaguuuaa

SEQ ID NO: 8345 - RNA, 24 nt, Homo Sapiens
ugucaccuaaaugcacuugauggu

SEQ ID NO: 8346 - RNA, 19 nt, Homo Sapiens
accuuaauaucacuugaug

SEQ ID NO: 8347 - RNA, 19 nt, Homo Sapiens
gucaccuaaaguuaacuug

SEQ ID NO: 8348 - RNA, 19 nt, Homo Sapiens
gucaccuaagggaaccuga

SEQ ID NO: 8349 - RNA, 20 nt, Homo Sapiens
ucaacuaaaugcacuuggug

SEQ ID NO: 8350 - RNA, 18 nt, Homo Sapiens
ucagcaagucacuugaug

SEQ ID NO: 8351 - RNA, 25 nt, Homo Sapiens
ugucacacauuuuaaaugcacuuga

SEQ ID NO: 8352 - RNA, 22 nt, Homo Sapiens
ugucaccuaacauacagauggu

SEQ ID NO: 8353 - RNA, 20 nt, Homo Sapiens
ugucagaaaaugcacucgau

SEQ ID NO: 8354 - RNA, 22 nt, Homo Sapiens
ugucacccaaaugcacuuuggu

SEQ ID NO: 8355 - RNA, 81 nt, Homo Sapiens
uuacuguuuauggaaggggagacuuaguaucauaaugaugucaaucuucugcauacugaucacuaauucaaucaacaauag

SEQ ID NO: 8356 - RNA, 24 nt, Homo Sapiens
uggaaggggagacuuaguaucaua

SEQ ID NO: 8357 - RNA, 20 nt, Homo Sapiens
aaggggagaggccuagucuc

SEQ ID NO: 8358 - RNA, 21 nt, Homo Sapiens
aaggggagacucacucaucau

SEQ ID NO: 8359 - RNA, 24 nt, Homo Sapiens
ggaaggggaauugccuaaguaaca

SEQ ID NO: 8360 - RNA, 20 nt, Homo Sapiens
ggaaggggaguuacaucaua

SEQ ID NO: 8361 - RNA, 19 nt, Homo Sapiens
ggggagggaguuaguauca

SEQ ID NO: 8362 - RNA, 21 nt, Homo Sapiens
uggaaggggcagccgugguau

SEQ ID NO: 8363 - RNA, 19 nt, Homo Sapiens
ugcaaggggagauugagua

SEQ ID NO: 8364 - RNA, 18 nt, Homo Sapiens
uggaagggggggcuugua

SEQ ID NO: 8365 - RNA, 22 nt, Homo Sapiens
uggcaggggagacguuuuacau

SEQ ID NO: 8366 - RNA, 76 nt, Homo Sapiens
uuaugaaaggugugaacuugcaauguccuccugucuuaaacccaaguugacagugcccucucaaaacuuuucauaa

SEQ ID NO: 8367 - RNA, 76 nt, Homo Sapiens; identical to SEQ ID NO: 8366

SEQ ID NO: 8368 - RNA, 76 nt, Homo Sapiens; identical to SEQ ID NO: 8366

SEQ ID NO: 8369 - RNA, 76 nt, Homo Sapiens; identical to SEQ ID NO: 8366

SEQ ID NO: 8370 - RNA, 76 nt, Homo Sapiens; identical to SEQ ID NO: 8366

SEQ ID NO: 8371 - RNA, 76 nt, Homo Sapiens; identical to SEQ ID NO: 8366

SEQ ID NO: 8372 - RNA, 76 nt, Homo Sapiens; identical to SEQ ID NO: 8366

SEQ ID NO: 8373 - RNA, 76 nt, Homo Sapiens; identical to SEQ ID NO: 8366

SEQ ID NO: 8374 - RNA, 76 nt, Homo Sapiens; identical to SEQ ID NO: 8366

SEQ ID NO: 8375 - RNA, 76 nt, Homo Sapiens; identical to SEQ ID NO: 8366

SEQ ID NO: 8376 - RNA, 76 nt, Homo Sapiens; identical to SEQ ID NO: 8366

SEQ ID NO: 8377 - RNA, 76 nt, Homo Sapiens; identical to SEQ ID NO: 8366

SEQ ID NO: 8378 - RNA, 76 nt, Homo Sapiens; identical to SEQ ID NO: 8366

SEQ ID NO: 8379 - RNA, 17 nt, Homo Sapiens
gguguaacugcaauguc

SEQ ID NO: 8380 - RNA, 76 nt, Homo Sapiens; identical to SEQ ID NO: 8366

SEQ ID NO: 8381 - RNA, 76 nt, Homo Sapiens; identical to SEQ ID NO: 8366

SEQ ID NO: 8382 - RNA, 76 nt, Homo Sapiens; identical to SEQ ID NO: 8366

SEQ ID NO: 8383 - RNA, 76 nt, Homo Sapiens; identical to SEQ ID NO: 8366

SEQ ID NO: 8384 - RNA, 76 nt, Homo Sapiens; identical to SEQ ID NO: 8366

SEQ ID NO: 8385 - RNA, 76 nt, Homo Sapiens; identical to SEQ ID NO: 8366

SEQ ID NO: 8386 - RNA, 76 nt, Homo Sapiens; identical to SEQ ID NO: 8366

SEQ ID NO: 8387 - RNA, 76 nt, Homo Sapiens; identical to SEQ ID NO: 8366

SEQ ID NO: 8388 - RNA, 76 nt, Homo Sapiens; identical to SEQ ID NO: 8366

SEQ ID NO: 8389 - RNA, 76 nt, Homo Sapiens; identical to SEQ ID NO: 8366

SEQ ID NO: 8390 - RNA, 77 nt, Homo Sapiens
uuaugaagacauacuggauggcaguggguacuucgaugugagggacaaggaggaccaguggauccggaucuucaugg

SEQ ID NO: 8391 - RNA, 24 nt, Homo Sapiens
auacuggauggcaguggguacuuc

SEQ ID NO: 8392 - RNA, 19 nt, Homo Sapiens
cuggauggcggcguucuuc

SEQ ID NO: 8393 - RNA, 18 nt, Homo Sapiens
uacugauaucagugggua

SEQ ID NO: 8394 - RNA, 66 nt, Homo Sapiens
uucgggcugugcaaggaggggaucaaggacggugccaccaugaagaccuuuugcggcacaccugag

SEQ ID NO: 8395 - RNA, 24 nt, Homo Sapiens
ugaagaccuuuugcggcacaccug

SEQ ID NO: 8396 - RNA, 21 nt, Homo Sapiens
aagacuuuuguaggcacaccu

SEQ ID NO: 8397 - RNA, 22 nt, Homo Sapiens
aagaccuuuuuuuucacgaccu

SEQ ID NO: 8398 - RNA, 19 nt, Homo Sapiens
agagccuugcgcggcacac

SEQ ID NO: 8399 - RNA, 25 nt, Homo Sapiens
agaccaacucuuccaggcacaccug

SEQ ID NO: 8400 - RNA, 19 nt, Homo Sapiens
agcccugucacggcacacc

SEQ ID NO: 8401 - RNA, 19 nt, Homo Sapiens
ccuucugucggcacaccug

SEQ ID NO: 8402 - RNA, 21 nt, Homo Sapiens
ugaagaccuugcucuggggca

SEQ ID NO: 8403 - RNA, 61 nt, Homo Sapiens
uucuguggagagaggucuaauauaauauguaguauuuuauguaaggcacuguuauacagaa

SEQ ID NO: 8404 - RNA, 22 nt, Homo Sapiens
uguaaggcacuguuauacagaa

SEQ ID NO: 8405 - RNA, 19 nt, Homo Sapiens
aaggucacuauauacagaa

SEQ ID NO: 8406 - RNA, 19 nt, Homo Sapiens
aaagaaaucuuauacagaa

SEQ ID NO: 8407 - RNA, 19 nt, Homo Sapiens
aagacaguuuuauacagaa

SEQ ID NO: 8408 - RNA, 18 nt, Homo Sapiens
aaggcacuguauaaauaa

SEQ ID NO: 8409 - RNA, 20 nt, Homo Sapiens
aggcacucuguuauacagaa

SEQ ID NO: 8410 - RNA, 19 nt, Homo Sapiens
cugauugauagaggucuaa

SEQ ID NO: 8411 - RNA, 25 nt, Homo Sapiens
cuguagcagugaggagcuaauauaa

SEQ ID NO: 8412 - RNA, 19 nt, Homo Sapiens
cuguggagaagggguguaa

SEQ ID NO: 8413 - RNA, 25 nt, Homo Sapiens
cuguggagaagugcucugcugauaa

SEQ ID NO: 8414 - RNA, 25 nt, Homo Sapiens
guagagccacuguuauuagacaaaa

SEQ ID NO: 8415 - RNA, 21 nt, Homo Sapiens
guaagucauaauuauacagaa

SEQ ID NO: 8416 - RNA, 20 nt, Homo Sapiens
guagagagagguugcuauaa

SEQ ID NO: 8417 - RNA, 16 nt, Homo Sapiens
uaaggcacugacagaa

SEQ ID NO: 8418 - RNA, 19 nt, Homo Sapiens
ucuuggagaugaggucuaa

SEQ ID NO: 8419 - RNA, 25 nt, Homo Sapiens
ucuuugcaaaguaagcucuaauaua

SEQ ID NO: 8420 - RNA, 22 nt, Homo Sapiens
ucuguggagugagggaccuaau

SEQ ID NO: 8421 - RNA, 23 nt, Homo Sapiens
ucugucgcugaggucuaagagaa

SEQ ID NO: 8422 - RNA, 20 nt, Homo Sapiens
uggaagagaggucuagauau

SEQ ID NO: 8423 - RNA, 19 nt, Homo Sapiens
uggagagagugucaauuua

SEQ ID NO: 8424 - RNA, 25 nt, Homo Sapiens
uguaaggcacugaaauuaacuacag

SEQ ID NO: 8425 - RNA, 24 nt, Homo Sapiens
uguaaugcuaugcaauauacagaa

SEQ ID NO: 8426 - RNA, 23 nt, Homo Sapiens
uguaaugcuuuuuauauacagaa

SEQ ID NO: 8427 - RNA, 24 nt, Homo Sapiens
uguaaggcagugauggacccagaa

SEQ ID NO: 8428 - RNA, 18 nt, Homo Sapiens
uguacgaaauguuauaca

SEQ ID NO: 8429 - RNA, 18 nt, Homo Sapiens
uguaaggcacuucaacag

SEQ ID NO: 8430 - RNA, 22 nt, Homo Sapiens
uguggagagucaggcugucuaa

SEQ ID NO: 8431 - RNA, 19 nt, Homo Sapiens
uguggagagaaauucaaua

SEQ ID NO: 8432 - RNA, 61 nt, Homo Sapiens
uucuuuggcauuuauucacuagaucucuaaacaggagaucacuguuucguaugcucuagag

SEQ ID NO: 8433 - RNA, 23 nt, Homo Sapiens
ucacuguuucguaugcucuagag

SEQ ID NO: 8434 - RNA, 19 nt, Homo Sapiens
cacugauuauugcucuaga

SEQ ID NO: 8435 - RNA, 22 nt, Homo Sapiens
cugucuccuugacugcucuaga

SEQ ID NO: 8436 - RNA, 26 nt, Homo Sapiens
ucacuguuucuggugcugcuuaagag

SEQ ID NO: 8437 - RNA, 21 nt, Homo Sapiens
ucacaguuucguuaugcucua

SEQ ID NO: 8438 - RNA, 18 nt, Homo Sapiens
ucacuguuuacucucucu

SEQ ID NO: 8439 - RNA, 19 nt, Homo Sapiens
ucacuguuuagaaagucua

SEQ ID NO: 8440 - RNA, 65 nt, Homo Sapiens
uugacauuguaggcuggcgcuggcaucagguucacacucauguucaugcccucuugcaucguuaa

SEQ ID NO: 8441 - RNA, 24 nt, Homo Sapiens
cauuguaggcuggcgcuggcauca

SEQ ID NO: 8442 - RNA, 20 nt, Homo Sapiens
aggcuggcgccgccgccuca

SEQ ID NO: 8443 - RNA, 23 nt, Homo Sapiens
auaggaagcauggcgcuggcauc

SEQ ID NO: 8444 - RNA, 20 nt, Homo Sapiens
augguaggcugggcgugggc

SEQ ID NO: 8445 - RNA, 25 nt, Homo Sapiens
auuguaggcugggugcgguggcuca

SEQ ID NO: 8446 - RNA, 22 nt, Homo Sapiens
cauuguaggcuggccaggcuca

SEQ ID NO: 8447 - RNA, 20 nt, Homo Sapiens
guaggcuggugaugucauca

SEQ ID NO: 8448 - RNA, 24 nt, Homo Sapiens
uuguaggcugcugcgcugacacca

SEQ ID NO: 8449 - RNA, 65 nt, Homo Sapiens
uugacauuguaggcuggcgcuggcaucagguucacacucauguucaugccucuuugcaucguuaa

SEQ ID NO: 8450 - RNA, 19 nt, Homo Sapiens
aggcuggcgucucucacca

SEQ ID NO: 8451 - RNA, 65 nt, Homo Sapiens; identical to SEQ ID NO: 8449

SEQ ID NO: 8452 - RNA, 65 nt, Homo Sapiens; identical to SEQ ID NO: 8449

SEQ ID NO: 8453 - RNA, 65 nt, Homo Sapiens; identical to SEQ ID NO: 8449

SEQ ID NO: 8454 - RNA, 65 nt, Homo Sapiens; identical to SEQ ID NO: 8449

SEQ ID NO: 8455 - RNA, 65 nt, Homo Sapiens; identical to SEQ ID NO: 8449

SEQ ID NO: 8456 - RNA, 65 nt, Homo Sapiens; identical to SEQ ID NO: 8449

SEQ ID NO: 8457 - RNA, 65 nt, Homo Sapiens; identical to SEQ ID NO: 8449

SEQ ID NO: 8458 - RNA, 65 nt, Homo Sapiens; identical to SEQ ID NO: 8449

SEQ ID NO: 8459 - RNA, 65 nt, Homo Sapiens; identical to SEQ ID NO: 8449

SEQ ID NO: 8460 - RNA, 65 nt, Homo Sapiens; identical to SEQ ID NO: 8449

SEQ ID NO: 8461 - RNA, 65 nt, Homo Sapiens; identical to SEQ ID NO: 8449

SEQ ID NO: 8462 - RNA, 65 nt, Homo Sapiens; identical to SEQ ID NO: 8449

SEQ ID NO: 8463 - RNA, 65 nt, Homo Sapiens; identical to SEQ ID NO: 8449

SEQ ID NO: 8464 - RNA, 20 nt, Homo Sapiens
uguaggcugggcgcgguggc

SEQ ID NO: 8465 - RNA, 65 nt, Homo Sapiens; identical to SEQ ID NO: 8449

SEQ ID NO: 8466 - RNA, 23 nt, Homo Sapiens
uguaggcugggcgcgguggcuca

SEQ ID NO: 8467 - RNA, 65 nt, Homo Sapiens; identical to SEQ ID NO: 8449

SEQ ID NO: 8468 - RNA, 65 nt, Homo Sapiens; identical to SEQ ID NO: 8449

SEQ ID NO: 8469 - RNA, 60 nt, Homo Sapiens
uugagaugggcacguggaagucaaaggguuucucuuuuuuuuuuuuuuuuccccuuuuag

SEQ ID NO: 8470 - RNA, 24 nt, Homo Sapiens
ugagaugggcacguggaagucaaa

SEQ ID NO: 8471 - RNA, 19 nt, Homo Sapiens
agaugggcaguuugaauuc

SEQ ID NO: 8472 - RNA, 20 nt, Homo Sapiens
agaugggcaaguccaagcaa

SEQ ID NO: 8473 - RNA, 20 nt, Homo Sapiens
augagucaguggaagucaaa

SEQ ID NO: 8474 - RNA, 25 nt, Homo Sapiens
gagaugggcgacggcggaggugcaa

SEQ ID NO: 8475 - RNA, 18 nt, Homo Sapiens
gagaugggcgcuggacgu

SEQ ID NO: 8476 - RNA, 21 nt, Homo Sapiens
gagaaggccauguggaaguca

SEQ ID NO: 8477 - RNA, 19 nt, Homo Sapiens
gagaugggccgcgggguca

SEQ ID NO: 8478 - RNA, 19 nt, Homo Sapiens
gaugggcacagagcaguca

SEQ ID NO: 8479 - RNA, 21 nt, Homo Sapiens
gggcacguggccccaaaguca

SEQ ID NO: 8480 - RNA, 20 nt, Homo Sapiens
ugacgcugagccguggaagu

SEQ ID NO: 8481 - RNA, 23 nt, Homo Sapiens
ugagaugcuagguguggaaguca

SEQ ID NO: 8482 - RNA, 20 nt, Homo Sapiens
ugggagggaagcacguggaa

SEQ ID NO: 8483 - RNA, 21 nt, Homo Sapiens
ugagaugggccaagaggaagu

SEQ ID NO: 8484 - RNA, 24 nt, Homo Sapiens
ugugaucgguacaugguggaaguc

SEQ ID NO: 8485 - RNA, 20 nt, Homo Sapiens
ugaaaugggcacguauggaa

SEQ ID NO: 8486 - RNA, 19 nt, Homo Sapiens
ugagauggagacguggaag

SEQ ID NO: 8487 - RNA, 19 nt, Homo Sapiens
ugagcugcagacguggaag

SEQ ID NO: 8488 - RNA, 19 nt, Homo Sapiens
ugugaggcccacguggaag

SEQ ID NO: 8489 - RNA, 21 nt, Homo Sapiens
ugagauggggguugggaguca

SEQ ID NO: 8490 - RNA, 21 nt, Homo Sapiens
ugggaucugcacguggaauca

SEQ ID NO: 8491 - RNA, 21 nt, Homo Sapiens
ugagaugggcguaaagucaaa

SEQ ID NO: 8492 - RNA, 21 nt, Homo Sapiens
ugggcagagagguggaaguca

SEQ ID NO: 8493 - RNA, 92 nt, Homo Sapiens
uugaguguuugauaagaguagcauuagguauuagugggaaaugauuggauuuuucauuuaagcauuguugggacaacuuguuaaccauuugg

SEQ ID NO: 8494 - RNA, 24 nt, Homo Sapiens
uaagaguagcauuagguauuagug

SEQ ID NO: 8495 - RNA, 24 nt, Homo Sapiens
aacagugagacauuagguagagug

SEQ ID NO: 8496 - RNA, 18 nt, Homo Sapiens
aagaguagcucugggauu

SEQ ID NO: 8497 - RNA, 17 nt, Homo Sapiens
aggagcaaguauuagug

SEQ ID NO: 8498 - RNA, 21 nt, Homo Sapiens
uaaagaagcagcuuagguauu

SEQ ID NO: 8499 - RNA, 24 nt, Homo Sapiens
uaagagugggguggcagguauuag

SEQ ID NO: 8500 - RNA, 20 nt, Homo Sapiens
uaaaguagcauuaucuggua

SEQ ID NO: 8501 - RNA, 16 nt, Homo Sapiens
uaagagcauuagguau

SEQ ID NO: 8502 - RNA, 18 nt, Homo Sapiens
uaagaguagcauugcuau

SEQ ID NO: 8503 - RNA, 18 nt, Homo Sapiens
uaagaguagcauguuuua

SEQ ID NO: 8504 - RNA, 18 nt, Homo Sapiens
uaagaggcaagguauuag

SEQ ID NO: 8505 - RNA, 20 nt, Homo Sapiens
uaagaguagccugguguuag

SEQ ID NO: 8506 - RNA, 21 nt, Homo Sapiens
uagcauuagcuuaaguuagug

SEQ ID NO: 8507 - RNA, 21 nt, Homo Sapiens
uagcauuaguuauugggagug

SEQ ID NO: 8508 - RNA, 61 nt, Homo Sapiens
uugaugucaugugucaagugcuuacugauuugauugaugaagaaguaaaaaguggcaucaa

SEQ ID NO: 8509 - RNA, 24 nt, Homo Sapiens
ugucaugugucaagugcuuacuga

SEQ ID NO: 8510 - RNA, 19 nt, Homo Sapiens
auuugucaagugaauacug

SEQ ID NO: 8511 - RNA, 21 nt, Homo Sapiens
gugauuuauugagugcuuacu

SEQ ID NO: 8512 - RNA, 18 nt, Homo Sapiens
ucaugugucuugcuuacu

SEQ ID NO: 8513 - RNA, 25 nt, Homo Sapiens
uguacagugccaauugugcuuacug

SEQ ID NO: 8514 - RNA, 21 nt, Homo Sapiens
uguccaugugucaaagagcuu

SEQ ID NO: 8515 - RNA, 19 nt, Homo Sapiens
ugucauguuuucaagugcu

SEQ ID NO: 8516 - RNA, 17 nt, Homo Sapiens
uguaugugcaagugcuu

SEQ ID NO: 8517 - RNA, 20 nt, Homo Sapiens
uguuagugucaaguggcuac

SEQ ID NO: 8518 - RNA, 23 nt, Homo Sapiens
ugucagaugaaaacugcuuacug

SEQ ID NO: 8519 - RNA, 68 nt, Homo Sapiens
uuggaugaggcccgcacacauuauggagggcaauuuucucuacugauuaaaagguuaauuucauccaa

SEQ ID NO: 8520 - RNA, 24 nt, Homo Sapiens
ugaggcccgcacacauuauggagg

SEQ ID NO: 8521 - RNA, 20 nt, Homo Sapiens
gacgccucccaacacauuau

SEQ ID NO: 8522 - RNA, 22 nt, Homo Sapiens
gaggcccgcacucagguucugg

SEQ ID NO: 8523 - RNA, 16 nt, Homo Sapiens
gaggccacacauuaug

SEQ ID NO: 8524 - RNA, 20 nt, Homo Sapiens
gaggcccgcuauuaaggagg

SEQ ID NO: 8525 - RNA, 20 nt, Homo Sapiens
gguccgcacacaguacagag

SEQ ID NO: 8526 - RNA, 19 nt, Homo Sapiens
ugaggcccgacacgcagua

SEQ ID NO: 8527 - RNA, 18 nt, Homo Sapiens
ugagacuccacacauuau

SEQ ID NO: 8528 - RNA, 68 nt, Homo Sapiens
uuguacagaccuuaguaaagucuucaauuuaauaaaaaucaaaaagccaaaacuaaaaggucaagcaa

SEQ ID NO: 8529 - RNA, 24 nt, Homo Sapiens
ucaaaaagccaaaacuaaaagguc

SEQ ID NO: 8530 - RNA, 26 nt, Homo Sapiens
aaaaagcagacaaauagcuaaaaggu

SEQ ID NO: 8531 - RNA, 18 nt, Homo Sapiens
aaaaagccaaagaaaagg

SEQ ID NO: 8532 - RNA, 19 nt, Homo Sapiens
aaaaagaaacuaaaaaguc

SEQ ID NO: 8533 - RNA, 22 nt, Homo Sapiens
aauaaggaauaaauaaaagguc

SEQ ID NO: 8534 - RNA, 25 nt, Homo Sapiens
aacagcaaucaaaacuaaaacgguc

SEQ ID NO: 8535 - RNA, 19 nt, Homo Sapiens
aaaagccaagcaacaaaaa

SEQ ID NO: 8536 - RNA, 20 nt, Homo Sapiens
aaagccaaaacaaaaagauc

SEQ ID NO: 8537 - RNA, 20 nt, Homo Sapiens
aagccaaaauccaaaugguc

SEQ ID NO: 8538 - RNA, 20 nt, Homo Sapiens
caaaaagggcaaaacuaaaa

SEQ ID NO: 8539 - RNA, 16 nt, Homo Sapiens
caaaacaaaacuaaaa

SEQ ID NO: 8540 - RNA, 19 nt, Homo Sapiens
caaaacccccaaacuaaaa

SEQ ID NO: 8541 - RNA, 22 nt, Homo Sapiens
cagaaaacuaauacuaaaaggu

SEQ ID NO: 8542 - RNA, 19 nt, Homo Sapiens
ucaaccaaagccaaaccua

SEQ ID NO: 8543 - RNA, 22 nt, Homo Sapiens
ucaaaagagauacaacuaaaag

SEQ ID NO: 8544 - RNA, 18 nt, Homo Sapiens
uccaaaagccaaacaaaa

SEQ ID NO: 8545 - RNA, 20 nt, Homo Sapiens
ucaaaaacaaaaaacuaaaa

SEQ ID NO: 8546 - RNA, 19 nt, Homo Sapiens
ucaaaaagcaaaacaaaaa

SEQ ID NO: 8547 - RNA, 19 nt, Homo Sapiens
ucaaaaagcaaaaccauaa

SEQ ID NO: 8548 - RNA, 22 nt, Homo Sapiens
ucaaaaagccaaaccaaagagg

SEQ ID NO: 8549 - RNA, 82 nt, Homo Sapiens
uugugucuuacuaaagcagcuuauuguagguguggcguucuaaaacguuuccugccugcgaugguucacaaaauaaacacaa

SEQ ID NO: 8550 - RNA, 24 nt, Homo Sapiens
aagcagcuuauuguagguguggcg

SEQ ID NO: 8551 - RNA, 18 nt, Homo Sapiens
aagccagcauuguaggug

SEQ ID NO: 8552 - RNA, 22 nt, Homo Sapiens
aaacagcuuauuucuaggcugu

SEQ ID NO: 8553 - RNA, 26 nt, Homo Sapiens
aagaaaauuauuguaggcugggugcg

SEQ ID NO: 8554 - RNA, 24 nt, Homo Sapiens
agcagcuuagagcuuguuugugug

SEQ ID NO: 8555 - RNA, 17 nt, Homo Sapiens
agcauuauuguaggagu

SEQ ID NO: 8556 - RNA, 17 nt, Homo Sapiens
agcagcuuagaggugug

SEQ ID NO: 8557 - RNA, 21 nt, Homo Sapiens
agcagcuuaauggauggaugg

SEQ ID NO: 8558 - RNA, 20 nt, Homo Sapiens
agcaccauuguagguauugc

SEQ ID NO: 8559 - RNA, 18 nt, Homo Sapiens
cagcuuauuggagggugg

SEQ ID NO: 8560 - RNA, 18 nt, Homo Sapiens
cagcuuauucucuguggc

SEQ ID NO: 8561 - RNA, 22 nt, Homo Sapiens
gcagacacuuauuguaagugug

SEQ ID NO: 8562 - RNA, 19 nt, Homo Sapiens
gcggccuugguaggugugg

SEQ ID NO: 8563 - RNA, 19 nt, Homo Sapiens
gcuuauccucuaggugugg

SEQ ID NO: 8564 - RNA, 66 nt, Homo Sapiens
uuguuuuuucgguugggcaugcugcuuaccgcaggaugauggaagcgacggcccguacaaagacag

SEQ ID NO: 8565 - RNA, 24 nt, Homo Sapiens
uggaagcgacggcccguacaaaga

SEQ ID NO: 8566 - RNA, 24 nt, Homo Sapiens
ggaaggggucaggcucguacaaag

SEQ ID NO: 8567 - RNA, 83 nt, Homo Sapiens
uuucaauuugacaauguccggcccuugaaauuucauacccggugggaaaauuuuaaauggccgggaccuugguugguuugaga

SEQ ID NO: 8568 - RNA, 24 nt, Homo Sapiens
uguccggcccuugaaauuucauac

SEQ ID NO: 8569 - RNA, 20 nt, Homo Sapiens
uccggcccuggagacguuca

SEQ ID NO: 8570 - RNA, 16 nt, Homo Sapiens
uccagcugaaauuuca

SEQ ID NO: 8571 - RNA, 24 nt, Homo Sapiens
uguccggccuuuccuagaaacuuc

SEQ ID NO: 8572 - RNA, 19 nt, Homo Sapiens
uguccgaucugaaauuuca

SEQ ID NO: 8573 - RNA, 71 nt, Homo Sapiens
uuucauuuaaaaaaugguuucagcaaauaugaaaauagaaaguccguuauuuguccauuuguaauaugaga

SEQ ID NO: 8574 - RNA, 24 nt, Homo Sapiens
ucauuuaaaaaaugguuucagcaa

SEQ ID NO: 8575 - RNA, 22 nt, Homo Sapiens
auuuccaagcugcuuucagcaa

SEQ ID NO: 8576 - RNA, 24 nt, Homo Sapiens
cauuuaaaaagauccucucaagca

SEQ ID NO: 8577 - RNA, 22 nt, Homo Sapiens
uuuaaaaaaaauguuucaggaa

SEQ ID NO: 8578 - RNA, 22 nt, Homo Sapiens
uuuaaaaaaaaguguucagcaa

SEQ ID NO: 8579 - RNA, 78 nt, Homo Sapiens
uuucggauacuuacauaguuuugcgggaagccagaucgaagauguaucccagcaagcacacuaggcagguggcugaga

SEQ ID NO: 8580 - RNA, 24 nt, Homo Sapiens
cagcaagcacacuaggcagguggc

SEQ ID NO: 8581 - RNA, 19 nt, Homo Sapiens
aagcacacucggagcaggu

SEQ ID NO: 8582 - RNA, 18 nt, Homo Sapiens
aagacgcaggcagguggc

SEQ ID NO: 8583 - RNA, 18 nt, Homo Sapiens
aagcucucugcagguggc

SEQ ID NO: 8584 - RNA, 19 nt, Homo Sapiens
acacuaccuggcagguggc

SEQ ID NO: 8585 - RNA, 23 nt, Homo Sapiens
agcaagcaccaagcguagguagc

SEQ ID NO: 8586 - RNA, 19 nt, Homo Sapiens
agcaagcacccaaggaggu

SEQ ID NO: 8587 - RNA, 20 nt, Homo Sapiens
aggaaaaaccuaggcaggug

SEQ ID NO: 8588 - RNA, 17 nt, Homo Sapiens
agcaagcaggcaggugg

SEQ ID NO: 8589 - RNA, 19 nt, Homo Sapiens
aggaagcaugggcaggugg

SEQ ID NO: 8590 - RNA, 21 nt, Homo Sapiens
agcaagcacagugcaaguggc

SEQ ID NO: 8591 - RNA, 18 nt, Homo Sapiens
caagcacugggcaggugg

SEQ ID NO: 8592 - RNA, 18 nt, Homo Sapiens
caaguccacggcaggugg

SEQ ID NO: 8593 - RNA, 20 nt, Homo Sapiens
cagggagacgaggcaggugg

SEQ ID NO: 8594 - RNA, 19 nt, Homo Sapiens
caagcacaccgcaggaggc

SEQ ID NO: 8595 - RNA, 22 nt, Homo Sapiens
cagcuuagcacacuaggguggc

SEQ ID NO: 8596 - RNA, 22 nt, Homo Sapiens
cagcaaugcaccaggcaggugg

SEQ ID NO: 8597 - RNA, 22 nt, Homo Sapiens
cagaagugcccucaggcaggug

SEQ ID NO: 8598 - RNA, 22 nt, Homo Sapiens
cagagggaaacugaggcaggug

SEQ ID NO: 8599 - RNA, 23 nt, Homo Sapiens
caggaagacaggacggcaggugg

SEQ ID NO: 8600 - RNA, 20 nt, Homo Sapiens
cagaagccagaaggcaggug

SEQ ID NO: 8601 - RNA, 19 nt, Homo Sapiens
caggaaggacaggcaggug

SEQ ID NO: 8602 - RNA, 21 nt, Homo Sapiens
cagaagcacacugaagggggc

SEQ ID NO: 8603 - RNA, 22 nt, Homo Sapiens
cagcaaugucacugcagguggc

SEQ ID NO: 8604 - RNA, 21 nt, Homo Sapiens
gcaagcacagugcugggcagg

SEQ ID NO: 8605 - RNA, 21 nt, Homo Sapiens
gcaagcagggcuggcaggugg

SEQ ID NO: 8606 - RNA, 21 nt, Homo Sapiens
gcaagcacacguauaaaggug

SEQ ID NO: 8607 - RNA, 25 nt, Homo Sapiens
gcagggagacucccaggcagguggc

SEQ ID NO: 8608 - RNA, 66 nt, Homo Sapiens
uuucggcgcugggucgcccaaagcaaaauggaaacggauagagugguggcucccagaaucccgaag

SEQ ID NO: 8609 - RNA, 24 nt, Homo Sapiens
uagagugguggcucccagaauccc

SEQ ID NO: 8610 - RNA, 19 nt, Homo Sapiens
agagugguggucuuccaga

SEQ ID NO: 8611 - RNA, 22 nt, Homo Sapiens
agagggaaggaucccagaaucc

SEQ ID NO: 8612 - RNA, 22 nt, Homo Sapiens
gagggcguggcucccagguucc

SEQ ID NO: 8613 - RNA, 26 nt, Homo Sapiens
gagugguggcacgcuccuguaauccc

SEQ ID NO: 8614 - RNA, 26 nt, Homo Sapiens
gaguggugguucacgccuguaauccc

SEQ ID NO: 8615 - RNA, 23 nt, Homo Sapiens
gagugguggcucauucagcaucc

SEQ ID NO: 8616 - RNA, 19 nt, Homo Sapiens
gauuggugcaccagaaucc

SEQ ID NO: 8617 - RNA, 20 nt, Homo Sapiens
guggcugcucccagauuucc

SEQ ID NO: 8618 - RNA, 20 nt, Homo Sapiens
gugguggcucauguaauccc

SEQ ID NO: 8619 - RNA, 20 nt, Homo Sapiens
uaaagugaaauggcucccag

SEQ ID NO: 8620 - RNA, 24 nt, Homo Sapiens
uagggaggcagaugccagaauccc

SEQ ID NO: 8621 - RNA, 66 nt, Homo Sapiens
uuucggcgcugggucgcccaaagcaaaauggagacggauagagugguggcucccaaaaucccgaaa

SEQ ID NO: 8622 - RNA, 24 nt, Homo Sapiens
uagagugguggcucccaaaauccc

SEQ ID NO: 8623 - RNA, 19 nt, Homo Sapiens
agagugguggguaauaaaa

SEQ ID NO: 8624 - RNA, 22 nt, Homo Sapiens
gagauggaggagcucccaaaau

SEQ ID NO: 8625 - RNA, 19 nt, Homo Sapiens
gagugcuaccggcucccaa

SEQ ID NO: 8626 - RNA, 20 nt, Homo Sapiens
gagugguggccuccagaaau

SEQ ID NO: 8627 - RNA, 19 nt, Homo Sapiens
guggcucccagaggauccc

SEQ ID NO: 8628 - RNA, 24 nt, Homo Sapiens
gugguggcucacguccguaauccc

SEQ ID NO: 8629 - RNA, 24 nt, Homo Sapiens
gugguggcucacaccuguaauccc

SEQ ID NO: 8630 - RNA, 24 nt, Homo Sapiens
gugguggcucacacuuguaauccc

SEQ ID NO: 8631 - RNA, 24 nt, Homo Sapiens
gugguggcucacaucuguaauccc

SEQ ID NO: 8632 - RNA, 24 nt, Homo Sapiens
guuguggcucccaccuguaauccc

SEQ ID NO: 8633 - RNA, 24 nt, Homo Sapiens
gugguggcucacaauuguaauccc

SEQ ID NO: 8634 - RNA, 19 nt, Homo Sapiens
uaaagugaaauggcuccca

SEQ ID NO: 8635 - RNA, 23 nt, Homo Sapiens
uauagucuggcucccacuaaaau

SEQ ID NO: 8636 - RNA, 20 nt, Homo Sapiens
uggucggcgcccaaaauccc

SEQ ID NO: 8637 - RNA, 20 nt, Homo Sapiens
uggucacuucccaaaaugcc

SEQ ID NO: 8638 - RNA, 23 nt, Homo Sapiens
ugguggcucacgccuauaauccc

SEQ ID NO: 8639 - RNA, 66 nt, Homo Sapiens
uuucggcgcugggucgcccaaagcagaauggagacggauagagugguggcucccaaaaucccgaag

SEQ ID NO: 8640 - RNA, 66 nt, Homo Sapiens; identical to SEQ ID NO: 8639

SEQ ID NO: 8641 - RNA, 66 nt, Homo Sapiens; identical to SEQ ID NO: 8639

SEQ ID NO: 8642 - RNA, 66 nt, Homo Sapiens; identical to SEQ ID NO: 8639

SEQ ID NO: 8643 - RNA, 66 nt, Homo Sapiens; identical to SEQ ID NO: 8639

SEQ ID NO: 8644 - RNA, 66 nt, Homo Sapiens; identical to SEQ ID NO: 8639

SEQ ID NO: 8645 - RNA, 66 nt, Homo Sapiens; identical to SEQ ID NO: 8639

SEQ ID NO: 8646 - RNA, 66 nt, Homo Sapiens; identical to SEQ ID NO: 8639

SEQ ID NO: 8647 - RNA, 66 nt, Homo Sapiens; identical to SEQ ID NO: 8639

SEQ ID NO: 8648 - RNA, 66 nt, Homo Sapiens; identical to SEQ ID NO: 8639

SEQ ID NO: 8649 - RNA, 66 nt, Homo Sapiens; identical to SEQ ID NO: 8639

SEQ ID NO: 8650 - RNA, 66 nt, Homo Sapiens; identical to SEQ ID NO: 8639

SEQ ID NO: 8651 - RNA, 66 nt, Homo Sapiens; identical to SEQ ID NO: 8639

SEQ ID NO: 8652 - RNA, 66 nt, Homo Sapiens; identical to SEQ ID NO: 8639

SEQ ID NO: 8653 - RNA, 66 nt, Homo Sapiens; identical to SEQ ID NO: 8639

SEQ ID NO: 8654 - RNA, 66 nt, Homo Sapiens; identical to SEQ ID NO: 8639

SEQ ID NO: 8655 - RNA, 66 nt, Homo Sapiens; identical to SEQ ID NO: 8639

SEQ ID NO: 8656 - RNA, 66 nt, Homo Sapiens; identical to SEQ ID NO: 8639

SEQ ID NO: 8657 - RNA, 66 nt, Homo Sapiens; identical to SEQ ID NO: 8639

SEQ ID NO: 8658 - RNA, 66 nt, Homo Sapiens; identical to SEQ ID NO: 8639

SEQ ID NO: 8659 - RNA, 66 nt, Homo Sapiens; identical to SEQ ID NO: 8639

SEQ ID NO: 8660 - RNA, 66 nt, Homo Sapiens; identical to SEQ ID NO: 8639

SEQ ID NO: 8661 - RNA, 66 nt, Homo Sapiens; identical to SEQ ID NO: 8639

SEQ ID NO: 8662 - RNA, 66 nt, Homo Sapiens; identical to SEQ ID NO: 8639

SEQ ID NO: 8663 - RNA, 66 nt, Homo Sapiens; identical to SEQ ID NO: 8639

SEQ ID NO: 8664 - RNA, 66 nt, Homo Sapiens; identical to SEQ ID NO: 8639

SEQ ID NO: 8665 - RNA, 66 nt, Homo Sapiens; identical to SEQ ID NO: 8639

SEQ ID NO: 8666 - RNA, 66 nt, Homo Sapiens; identical to SEQ ID NO: 8639

SEQ ID NO: 8667 - RNA, 66 nt, Homo Sapiens; identical to SEQ ID NO: 8639

SEQ ID NO: 8668 - RNA, 66 nt, Homo Sapiens; identical to SEQ ID NO: 8639

SEQ ID NO: 8669 - RNA, 66 nt, Homo Sapiens; identical to SEQ ID NO: 8639

SEQ ID NO: 8670 - RNA, 66 nt, Homo Sapiens
uuucggcgcugggucgcccaaagcagaauggagacggauagagugguggcucccagaaucccgaag

SEQ ID NO: 8671 - RNA, 66 nt, Homo Sapiens; identical to SEQ ID NO: 8670

SEQ ID NO: 8672 - RNA, 66 nt, Homo Sapiens; identical to SEQ ID NO: 8670

SEQ ID NO: 8673 - RNA, 66 nt, Homo Sapiens; identical to SEQ ID NO: 8670

SEQ ID NO: 8674 - RNA, 66 nt, Homo Sapiens; identical to SEQ ID NO: 8670

SEQ ID NO: 8675 - RNA, 21 nt, Homo Sapiens
agugguggcuugcugcuuccc

SEQ ID NO: 8676 - RNA, 66 nt, Homo Sapiens; identical to SEQ ID NO: 8670

SEQ ID NO: 8677 - RNA, 66 nt, Homo Sapiens; identical to SEQ ID NO: 8670

SEQ ID NO: 8678 - RNA, 66 nt, Homo Sapiens; identical to SEQ ID NO: 8670

SEQ ID NO: 8679 - RNA, 66 nt, Homo Sapiens; identical to SEQ ID NO: 8670

SEQ ID NO: 8680 - RNA, 66 nt, Homo Sapiens; identical to SEQ ID NO: 8670

SEQ ID NO: 8681 - RNA, 66 nt, Homo Sapiens; identical to SEQ ID NO: 8670

SEQ ID NO: 8682 - RNA, 66 nt, Homo Sapiens; identical to SEQ ID NO: 8670

SEQ ID NO: 8683 - RNA, 66 nt, Homo Sapiens; identical to SEQ ID NO: 8670

SEQ ID NO: 8684 - RNA, 66 nt, Homo Sapiens; identical to SEQ ID NO: 8670

SEQ ID NO: 8685 - RNA, 66 nt, Homo Sapiens; identical to SEQ ID NO: 8670

SEQ ID NO: 8686 - RNA, 66 nt, Homo Sapiens; identical to SEQ ID NO: 8670

SEQ ID NO: 8687 - RNA, 66 nt, Homo Sapiens; identical to SEQ ID NO: 8670

SEQ ID NO: 8688 - RNA, 24 nt, Homo Sapiens
gugguggcucaccccuguaauccc

SEQ ID NO: 8689 - RNA, 66 nt, Homo Sapiens; identical to SEQ ID NO: 8670

SEQ ID NO: 8690 - RNA, 66 nt, Homo Sapiens; identical to SEQ ID NO: 8670

SEQ ID NO: 8691 - RNA, 66 nt, Homo Sapiens; identical to SEQ ID NO: 8670

SEQ ID NO: 8692 - RNA, 66 nt, Homo Sapiens; identical to SEQ ID NO: 8670

SEQ ID NO: 8693 - RNA, 66 nt, Homo Sapiens; identical to SEQ ID NO: 8670

SEQ ID NO: 8694 - RNA, 24 nt, Homo Sapiens
gugguggcucaugccuguaauccc

SEQ ID NO: 8695 - RNA, 66 nt, Homo Sapiens; identical to SEQ ID NO: 8670

SEQ ID NO: 8696 - RNA, 66 nt, Homo Sapiens; identical to SEQ ID NO: 8670

SEQ ID NO: 8697 - RNA, 66 nt, Homo Sapiens; identical to SEQ ID NO: 8670

SEQ ID NO: 8698 - RNA, 66 nt, Homo Sapiens; identical to SEQ ID NO: 8670

SEQ ID NO: 8699 - RNA, 66 nt, Homo Sapiens; identical to SEQ ID NO: 8670

SEQ ID NO: 8700 - RNA, 66 nt, Homo Sapiens; identical to SEQ ID NO: 8670

SEQ ID NO: 8701 - RNA, 66 nt, Homo Sapiens; identical to SEQ ID NO: 8670

SEQ ID NO: 8702 - RNA, 66 nt, Homo Sapiens; identical to SEQ ID NO: 8670

SEQ ID NO: 8703 - RNA, 66 nt, Homo Sapiens; identical to SEQ ID NO: 8670

SEQ ID NO: 8704 - RNA, 66 nt, Homo Sapiens; identical to SEQ ID NO: 8670

SEQ ID NO: 8705 - RNA, 66 nt, Homo Sapiens; identical to SEQ ID NO: 8670

SEQ ID NO: 8706 - RNA, 66 nt, Homo Sapiens; identical to SEQ ID NO: 8670

SEQ ID NO: 8707 - RNA, 66 nt, Homo Sapiens; identical to SEQ ID NO: 8670

SEQ ID NO: 8708 - RNA, 19 nt, Homo Sapiens
uggcugccuccagaauccc

SEQ ID NO: 8709 - RNA, 66 nt, Homo Sapiens; identical to SEQ ID NO: 8670

SEQ ID NO: 8710 - RNA, 22 nt, Homo Sapiens
ugguggcucacgccuguaaucc

SEQ ID NO: 8711 - RNA, 66 nt, Homo Sapiens; identical to SEQ ID NO: 8670

SEQ ID NO: 8712 - RNA, 23 nt, Homo Sapiens
ugguggcucacgccugcaauccc

SEQ ID NO: 8713 - RNA, 66 nt, Homo Sapiens; identical to SEQ ID NO: 8670

SEQ ID NO: 8714 - RNA, 19 nt, Homo Sapiens
ugcuggcucccaggcuccc

SEQ ID NO: 8715 - RNA, 75 nt, Homo Sapiens
uuugaaugacuuguaaugauggcugcuaagcauauccuguacuguggcuaugucaauuugcgaauccuccucaaa

SEQ ID NO: 8716 - RNA, 24 nt, Homo Sapiens
ugacuuguaaugauggcugcuaag

SEQ ID NO: 8717 - RNA, 21 nt, Homo Sapiens
acuuguaauuugguuucuaag

SEQ ID NO: 8718 - RNA, 21 nt, Homo Sapiens
cuuagugaugaaauggcugcu

SEQ ID NO: 8719 - RNA, 19 nt, Homo Sapiens
cuuguuacuuuggcugcua

SEQ ID NO: 8720 - RNA, 27 nt, Homo Sapiens
gacuuguaauggugaugcuuuggcuaa

SEQ ID NO: 8721 - RNA, 20 nt, Homo Sapiens
ugacuuguauuuccauggcu

SEQ ID NO: 8722 - RNA, 23 nt, Homo Sapiens
ugacuuguaucaauggcucugag

SEQ ID NO: 8723 - RNA, 23 nt, Homo Sapiens
uuauaagcugaugagcugcuaag

SEQ ID NO: 8724 - RNA, 78 nt, Homo Sapiens
uuugagauguacgaccuggacggcgacgggcgcaucacgcgccuggagaugcuggagaucaucgaggcaaucuacaag

SEQ ID NO: 8725 - RNA, 24 nt, Homo Sapiens
uguacgaccuggacggcgacgggc

SEQ ID NO: 8726 - RNA, 19 nt, Homo Sapiens
accuggacguggggcgugc

SEQ ID NO: 8727 - RNA, 20 nt, Homo Sapiens
guacgcggguggcgacgggc

SEQ ID NO: 8728 - RNA, 67 nt, Homo Sapiens
uuuguuaauguuucaaacauacuuucuugguuuucuaauggaguauauaguuuagucauuucacaga

SEQ ID NO: 8729 - RNA, 24 nt, Homo Sapiens
ggaguauauaguuuagucauuuca

SEQ ID NO: 8730 - RNA, 22 nt, Homo Sapiens
aguauauaguuaaagaacauuu

SEQ ID NO: 8731 - RNA, 21 nt, Homo Sapiens
aguuuauaguuuacagccauu

SEQ ID NO: 8732 - RNA, 22 nt, Homo Sapiens
aguuauaguuuacucagcuuca

SEQ ID NO: 8733 - RNA, 20 nt, Homo Sapiens
auagaaauugagucauuuca

SEQ ID NO: 8734 - RNA, 22 nt, Homo Sapiens
gagaauaaguuuagucccuuuc

SEQ ID NO: 8735 - RNA, 18 nt, Homo Sapiens
gaauuuauaguuuaucau

SEQ ID NO: 8736 - RNA, 18 nt, Homo Sapiens
gaggaauauuuuagucau

SEQ ID NO: 8737 - RNA, 23 nt, Homo Sapiens
gaguauauagaucaacauguuca

SEQ ID NO: 8738 - RNA, 26 nt, Homo Sapiens
ggaguauauucauuuuccugucauuu

SEQ ID NO: 8739 - RNA, 23 nt, Homo Sapiens
ggagauaagguuuuagucauauc

SEQ ID NO: 8740 - RNA, 22 nt, Homo Sapiens
ggaguauaucgucuacacaauu

SEQ ID NO: 8741 - RNA, 19 nt, Homo Sapiens
ggaguauauuuuaauuuuc

SEQ ID NO: 8742 - RNA, 21 nt, Homo Sapiens
guauauaguucugugucauuu

SEQ ID NO: 8743 - RNA, 20 nt, Homo Sapiens
uauauaguucacucuuugca

SEQ ID NO: 8744 - RNA, 72 nt, Homo Sapiens
uuuuuuucagugaacauguuuuuauugaacaccaacuuaauuucaggaacauuucagguacauugucagaaa

SEQ ID NO: 8745 - RNA, 24 nt, Homo Sapiens
uuucaggaacauuucagguacauu

SEQ ID NO: 8746 - RNA, 23 nt, Homo Sapiens
aacuauucuuuuauugaacauca

SEQ ID NO: 8747 - RNA, 20 nt, Homo Sapiens
aaaauauuuauuauugaaca

SEQ ID NO: 8748 - RNA, 20 nt, Homo Sapiens
aacauguuuuugguugauca

SEQ ID NO: 8749 - RNA, 19 nt, Homo Sapiens
aacauguuuuuccuaacac

SEQ ID NO: 8750 - RNA, 21 nt, Homo Sapiens
aacaaauauuuauugaacacc

SEQ ID NO: 8751 - RNA, 22 nt, Homo Sapiens
aacauuucuguuuugaacacca

SEQ ID NO: 8752 - RNA, 20 nt, Homo Sapiens
acauuuuuuauugaauucca

SEQ ID NO: 8753 - RNA, 21 nt, Homo Sapiens
aggaaacacauuucaggaaca

SEQ ID NO: 8754 - RNA, 21 nt, Homo Sapiens
caggaucugcuucagguacau

SEQ ID NO: 8755 - RNA, 18 nt, Homo Sapiens
caggagcuuucagguaca

SEQ ID NO: 8756 - RNA, 20 nt, Homo Sapiens
cauguucuuuauugaacacc

SEQ ID NO: 8757 - RNA, 19 nt, Homo Sapiens
gaacaguuuguuuuuauug

SEQ ID NO: 8758 - RNA, 19 nt, Homo Sapiens
gaacaggugcuuuuauuga

SEQ ID NO: 8759 - RNA, 19 nt, Homo Sapiens
gagcagauuuuuauugaac

SEQ ID NO: 8760 - RNA, 20 nt, Homo Sapiens
gaacauguuuuuguuacaca

SEQ ID NO: 8761 - RNA, 18 nt, Homo Sapiens
gaacauguuuuauuacac

SEQ ID NO: 8762 - RNA, 21 nt, Homo Sapiens
gaacgugguuuuugaacacca

SEQ ID NO: 8763 - RNA, 21 nt, Homo Sapiens
ucagagaacaaaucagguaca

SEQ ID NO: 8764 - RNA, 25 nt, Homo Sapiens
ucaggguuaacauuucaagaucauu

SEQ ID NO: 8765 - RNA, 20 nt, Homo Sapiens
ucagguacaucagguacauu

SEQ ID NO: 8766 - RNA, 21 nt, Homo Sapiens
ucaugaaaaaucagguacauu

SEQ ID NO: 8767 - RNA, 28 nt, Homo Sapiens
ugaacaaguuugguuuuggugaacacca

SEQ ID NO: 8768 - RNA, 25 nt, Homo Sapiens
ugaacauguuuuguuaucuuaauac

SEQ ID NO: 8769 - RNA, 19 nt, Homo Sapiens
ugaacauguuucccuugaa

SEQ ID NO: 8770 - RNA, 19 nt, Homo Sapiens
ugaacauguauuuuuaaac

SEQ ID NO: 8771 - RNA, 19 nt, Homo Sapiens
ugaacaauuuuauugagca

SEQ ID NO: 8772 - RNA, 21 nt, Homo Sapiens
uguacauguuuuaauaaaaca

SEQ ID NO: 8773 - RNA, 22 nt, Homo Sapiens
ugaaagaguauuuauugaaaac

SEQ ID NO: 8774 - RNA, 25 nt, Homo Sapiens
uucaagggaacauuuaggauagauu

SEQ ID NO: 8775 - RNA, 19 nt, Homo Sapiens
uucaggaaacacauuucag

SEQ ID NO: 8776 - RNA, 21 nt, Homo Sapiens
uucaggaacauguucaugaca

SEQ ID NO: 8777 - RNA, 21 nt, Homo Sapiens
uuaaggaacauuuuccaggua

SEQ ID NO: 8778 - RNA, 19 nt, Homo Sapiens
uugaggaacauuaggcaca

SEQ ID NO: 8779 - RNA, 20 nt, Homo Sapiens
uucaaaaacauuucagcauu

SEQ ID NO: 8780 - RNA, 20 nt, Homo Sapiens
uuucgaaaggaacauuccag

SEQ ID NO: 8781 - RNA, 24 nt, Homo Sapiens
uuuuaggaugcagcauuucaggua

SEQ ID NO: 8782 - RNA, 19 nt, Homo Sapiens
uuuggggaacauuuacagg

SEQ ID NO: 8783 - RNA, 25 nt, Homo Sapiens
uuuuugaaacguauacagguacauu

SEQ ID NO: 8784 - RNA, 24 nt, Homo Sapiens
uuucugaacauuucucuguacuuu

SEQ ID NO: 8785 - RNA, 22 nt, Homo Sapiens
uuccacaaaccucucagguaca

SEQ ID NO: 8786 - RNA, 20 nt, Homo Sapiens
uuucagaaacuucagguaca

SEQ ID NO: 8787 - RNA, 24 nt, Homo Sapiens
uuuaaauaacauuucaaguauauu

SEQ ID NO: 8788 - DNA, 705 bp, Homo Sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 8789 - DNA, 1262 bp, Homo Sapiens
gcaaaaactggaagcattccctttgaaaactggcacaagacagggatgccctctctcaccgctcctattcaacatagtgttggaagttctggccagggcaattaggcaggagaaggaaataaagggtattcaattaggaaaagagcaagtcaaattgttcctgtttgcagatgacatgattgtatatctagaaaaccccattgtctcagccccaaatctccttaagctgataagcaacttcagcaaagtctcaggatacaaaataaatgtacaaaaatcacaagcattcttacacaccaacaacagaaaaacagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactttactacaaggctacagtaaccaaaacagcatggtactggtaccaaaacagagatatagatcaatggaacagaacagagccctcagaaataacgccgaatacctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaaaaaaaaaaaaaaa

SEQ ID NO: 8790 - DNA, 1445 bp, Homo Sapiens
actcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggcccgtttcaatttgctgcaaatggctagccagttctcccagcaccatttattaaatagggaatcttttccccattgcttccttttgtcaggtttgtcaaagatcacatggttgtaggtgtgtggtcttatttctgggttctctattctgttccattgggctatgggccggttctgtaccaccactatgctgttttgggtaccatagtcttgtagaatgtttgaagctgggtagcatgatgcctctagctttgctcttcttgctaagaaatgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctagatattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagctcgtgccaa

SEQ ID NO: 8791 - DNA, 42 bp, Homo Sapiens
taatacgactcactatagggtgaggtagtaagttgtattgtt

SEQ ID NO: 8792 - DNA, 41 bp, Homo Sapiens
aattaaccctcactaaagggaaagtagtaagttgtatagtt

SEQ ID NO: 8793 - DNA, 40 bp, Homo Sapiens
taatacgactcactataggcccttattagaggattctgct

SEQ ID NO: 8794 - DNA, 41 bp, Homo Sapiens
aattaaccctcactaaaggtttttttttcctgagacagagt

SEQ ID NO: 8795 - DNA, 20 bp, Homo Sapiens
gaggcaggagaattgcttga

SEQ ID NO: 8796 - DNA, 39 bp, Homo Sapiens
aattaaccctcactaaaggcctgagacagagtcttgctc

SEQ ID NO: 8797 - DNA, 252 bp, Homo sapiens
gggttatctgcaactgagaggggctggttaaggcgtccccaagttggaagggcgctttgcttctgttttctggatgcagagtcctctgactccctctgccacgggctgagtttccggctccaggttcgcgtgtcgccctgaggtttgaggccagacagctcgcagtcgggcagggagggcgggggagagacgagcggctctggccccttaattgtacttcgggctcgtattgtctctcctttcgccacctcc

---

What is claimed:

1. An isolated nucleic acid consisting of X nucleotides wherein the sequence of the nucleic acid comprises:
   (a) Y consecutive nucleotides of SEQ ID NO: 8797;
   (b) an RNA equivalent of (a); or
   (c) the complement of (a) or (b),
   wherein
   X=18 to 120,
   $Y \geq 18$, and
   $X \geq Y$.

2. The nucleic acid of claim 1, wherein the Y nucleotides are of SEQ ID NO: 5135 or 6033.

3. The nucleic acid of claim 1, wherein the Y nucleotides are of SEQ ID NO: 5136 or 6034.

4. The nucleic acid of claim 1, wherein X=18 to 24.
5. The nucleic acid of claim 1, wherein X=Y.
6. The nucleic acid of claim 2, wherein X=Y.
7. The nucleic acid of claim 3, wherein X=Y.
8. The nucleic acid of claim 4, wherein X=Y.
9. A vector comprising the nucleic acid of claim 1.
10. A vector comprising the nucleic acid of claim 2.
11. A vector comprising the nucleic acid of claim 3.
12. A vector comprising the nucleic acid of claim 4.
13. A vector comprising the nucleic acid of claim 5.
14. A vector comprising the nucleic acid of claim 6.
15. A vector comprising the nucleic acid of claim 7.
16. A vector comprising the nucleic acid of claim 8.

* * * * *